(12) United States Patent
Schellenberger et al.

(10) Patent No.: US 10,421,798 B2
(45) Date of Patent: Sep. 24, 2019

(54) FACTOR VIII COMPOSITIONS AND METHODS OF MAKING AND USING SAME

(75) Inventors: Volker Schellenberger, Palo Alto, CA (US); Pei-Yun Chang, Menlo Park, CA (US); Fatbardha Varfaj, Mountain View, CA (US); Sheng Ding, Redwood City, CA (US); Joshua Silverman, Sunnyvale, CA (US); Chia-wei Wang, Milpitas, CA (US); Benjamin Spink, San Carlos, CA (US); Willem P. Stemmer, Los Gatos, CA (US); Volker Schellenberger, legal representative, Palo Alto, CA (US); Nathan Geething, Santa Clara, CA (US); John Kulman, Belmont, MA (US); Tongyao Liu, Lexington, MA (US); Garabet G. Toby, North Reading, MA (US); Haiyan Jiang, Belmont, MA (US); Robert Peters, Needham, MA (US); Deping Wang, Sharon, MA (US); Baisong Mei, Waban, MA (US)

(73) Assignee: BIOVERATIV THERAPEUTICS INC., Waltham, MA (US)

( * ) Notice: Subject to any disclaimer, the term of this patent is extended or adjusted under 35 U.S.C. 154(b) by 316 days.

(21) Appl. No.: 14/379,192

(22) PCT Filed: Jul. 11, 2012

(86) PCT No.: PCT/US2012/046326
§ 371 (c)(1),
(2), (4) Date: Feb. 20, 2015

(87) PCT Pub. No.: WO2013/122617
PCT Pub. Date: Aug. 22, 2013

(65) Prior Publication Data
US 2015/0158929 A1   Jun. 11, 2015

Related U.S. Application Data

(60) Provisional application No. 61/599,400, filed on Feb. 15, 2012.

(51) Int. Cl.
*C07K 14/755* (2006.01)
*A61K 38/00* (2006.01)

(52) U.S. Cl.
CPC .......... *C07K 14/755* (2013.01); *A61K 38/00* (2013.01); *C07K 2319/31* (2013.01)

(58) Field of Classification Search
None
See application file for complete search history.

(56) References Cited

U.S. PATENT DOCUMENTS

| | | |
|---|---|---|
| 3,992,518 A | 11/1976 | Chien et al. |
| 4,088,864 A | 5/1978 | Theeuwes et al. |
| 4,179,337 A | 12/1979 | Davis et al. |
| 4,200,098 A | 4/1980 | Ayer et al. |
| 4,200,984 A | 5/1980 | Fink |
| 4,215,051 A | 7/1980 | Palmer et al. |
| 4,284,444 A | 8/1981 | Bernstein et al. |
| 4,398,908 A | 8/1983 | Siposs |
| 4,435,173 A | 3/1984 | Siposs et al. |
| 4,456,591 A | 6/1984 | Thomas |
| 4,542,025 A | 9/1985 | Tice et al. |
| 4,599,311 A | 7/1986 | Kawasaki |
| 4,683,195 A | 7/1987 | Mullis et al. |
| 4,683,202 A | 7/1987 | Mullis |
| 4,684,479 A | 8/1987 | D'Arrigo |
| 4,713,339 A | 12/1987 | Levinson et al. |
| 4,757,006 A | 7/1988 | Toole, Jr. et al. |
| 4,770,999 A | 9/1988 | Kaufman et al. |
| 4,784,950 A | 11/1988 | Hagen et al. |
| 4,800,159 A | 1/1989 | Mullis et al. |
| 4,845,075 A | 7/1989 | Murray et al. |
| 4,861,800 A | 8/1989 | Buyske |
| 4,868,112 A | 9/1989 | Toole, Jr. |
| 4,870,008 A | 9/1989 | Brake |
| 4,882,279 A | 11/1989 | Cregg |
| 4,897,268 A | 1/1990 | Tice et al. |
| 4,931,373 A | 6/1990 | Kawasaki et al. |
| 4,933,185 A | 6/1990 | Wheatley et al. |
| 4,965,188 A | 10/1990 | Mullis et al. |
| 4,965,199 A | 10/1990 | Capon et al. |
| 4,976,696 A | 12/1990 | Sanderson et al. |
| 4,988,337 A | 1/1991 | Ito |
| 4,994,371 A | 2/1991 | Davie et al. |
| 5,004,803 A | 4/1991 | Kaufman et al. |
| 5,004,804 A | 4/1991 | Kuo et al. |
| 5,017,378 A | 5/1991 | Turner et al. |
| 5,037,743 A | 8/1991 | Welch et al. |
| 5,089,474 A | 2/1992 | Castro et al. |
| 5,112,950 A | 5/1992 | Meulien et al. |
| 5,171,844 A | 12/1992 | Van et al. |
| 5,176,502 A | 1/1993 | Sanderson et al. |
| 5,186,938 A | 2/1993 | Sablotsky et al. |
| 5,198,349 A | 3/1993 | Kaufman |
| 5,215,680 A | 6/1993 | D'Arrigo |

(Continued)

FOREIGN PATENT DOCUMENTS

| | | |
|---|---|---|
| AU | 609829 B2 | 5/1991 |
| CN | 1761684 A | 4/2006 |

(Continued)

OTHER PUBLICATIONS

Meloun et al., Complete Amino Acid Sequence of Human Serum Albumin, FEBS Letters; 1975; 134-137 (Year: 1975).*

(Continued)

*Primary Examiner* — Lianko G Garyu
(74) *Attorney, Agent, or Firm* — Lathrop Gage LLP; James H. Velema, Esq.

(57) ABSTRACT

The present invention relates to compositions comprising factor VIII coagulation factors linked to extended recombinant polypeptide (XTEN), isolated nucleic acids encoding the compositions and vectors and host cells containing the same, and methods of making and using such compositions in treatment of factor VIII-related diseases, disorders, and conditions.

44 Claims, 62 Drawing Sheets

Specification includes a Sequence Listing.

(56) References Cited

U.S. PATENT DOCUMENTS

| | | |
|---|---|---|
| 5,223,409 A | 6/1993 | Ladner et al. |
| 5,250,421 A | 10/1993 | Kaufman et al. |
| 5,270,176 A | 12/1993 | Doerschug et al. |
| 5,298,022 A | 3/1994 | Bernardi |
| 5,318,540 A | 6/1994 | Athayde et al. |
| 5,364,771 A | 11/1994 | Lollar et al. |
| 5,364,934 A | 11/1994 | Drayna et al. |
| 5,407,609 A | 4/1995 | Tice et al. |
| 5,424,199 A | 6/1995 | Goeddel et al. |
| 5,492,534 A | 2/1996 | Athayde et al. |
| 5,534,617 A | 7/1996 | Cunningham et al. |
| 5,543,502 A | 8/1996 | Nordfang et al. |
| 5,554,730 A | 9/1996 | Woiszwillo et al. |
| 5,573,776 A | 11/1996 | Harrison et al. |
| 5,576,291 A | 11/1996 | Curtis et al. |
| 5,578,709 A | 11/1996 | Woiszwillo |
| 5,595,886 A | 1/1997 | Chapman et al. |
| 5,599,907 A | 2/1997 | Anderson et al. |
| 5,610,278 A | 3/1997 | Nordfang et al. |
| 5,643,575 A | 7/1997 | Martinez et al. |
| 5,648,260 A | 7/1997 | Winter et al. |
| 5,658,570 A | 8/1997 | Newman et al. |
| 5,660,848 A | 8/1997 | Moo-Young |
| 5,712,122 A | 1/1998 | Boime et al. |
| 5,739,277 A | 4/1998 | Presta et al. |
| 5,756,115 A | 5/1998 | Moo-Young et al. |
| 5,789,203 A | 8/1998 | Chapman et al. |
| 5,833,982 A | 11/1998 | Berkner et al. |
| 5,834,250 A | 11/1998 | Wells et al. |
| 5,837,679 A | 11/1998 | Wolf et al. |
| 5,846,951 A | 12/1998 | Gregoriadis |
| 5,859,204 A | 1/1999 | Lollar |
| 5,869,046 A | 2/1999 | Presta et al. |
| 5,874,104 A | 2/1999 | Adler-Moore et al. |
| 5,916,588 A | 6/1999 | Popescu et al. |
| 5,919,766 A | 7/1999 | Osterberg et al. |
| 5,942,252 A | 8/1999 | Tice et al. |
| 5,965,156 A | 10/1999 | Proffitt et al. |
| 5,972,885 A | 10/1999 | Spira et al. |
| 5,981,216 A | 11/1999 | Kenten et al. |
| 5,981,719 A | 11/1999 | Woiszwillo et al. |
| 6,005,082 A | 12/1999 | Smeds |
| 6,024,983 A | 2/2000 | Tice et al. |
| 6,030,613 A | 2/2000 | Blumberg et al. |
| 6,037,452 A | 3/2000 | Minamino et al. |
| 6,043,094 A | 3/2000 | Martin et al. |
| 6,048,720 A | 4/2000 | Dalborg et al. |
| 6,056,973 A | 5/2000 | Allen et al. |
| 6,060,447 A | 5/2000 | Chapman et al. |
| 6,086,875 A | 7/2000 | Blumberg et al. |
| 6,090,925 A | 7/2000 | Woiszwillo et al. |
| 6,096,871 A | 8/2000 | Presta et al. |
| 6,110,498 A | 8/2000 | Rudnic et al. |
| 6,121,022 A | 9/2000 | Presta et al. |
| 6,126,966 A | 10/2000 | Abra et al. |
| 6,183,770 B1 | 2/2001 | Muchin et al. |
| 6,194,551 B1 | 2/2001 | Idusogie et al. |
| 6,228,620 B1 | 5/2001 | Chapman et al. |
| 6,242,195 B1 | 6/2001 | Idusogie et al. |
| 6,251,632 B1 | 6/2001 | Lillicrap et al. |
| 6,254,573 B1 | 7/2001 | Haim et al. |
| 6,268,053 B1 | 7/2001 | Woiszwillo et al. |
| 6,277,375 B1 | 8/2001 | Ward |
| 6,284,276 B1 | 9/2001 | Rudnic et al. |
| 6,294,170 B1 | 9/2001 | Boone et al. |
| 6,294,191 B1 | 9/2001 | Meers et al. |
| 6,294,201 B1 | 9/2001 | Kettelhoit et al. |
| 6,303,148 B1 | 10/2001 | Hennink et al. |
| 6,309,370 B1 | 10/2001 | Haim et al. |
| 6,310,183 B1 | 10/2001 | Johannessen et al. |
| 6,316,024 B1 | 11/2001 | Allen et al. |
| 6,316,226 B1 | 11/2001 | Van et al. |
| 6,329,186 B1 | 12/2001 | Nielsen et al. |
| 6,346,513 B1 | 2/2002 | Van et al. |
| 6,352,716 B1 | 3/2002 | Janoff et al. |
| 6,352,721 B1 | 3/2002 | Faour |
| 6,358,703 B1 | 3/2002 | Cho et al. |
| 6,361,796 B1 | 3/2002 | Rudnic et al. |
| 6,376,463 B1 | 4/2002 | Lollar |
| 6,395,302 B1 | 5/2002 | Hennink et al. |
| 6,406,632 B1 | 6/2002 | Safir et al. |
| 6,406,713 B1 | 6/2002 | Janoff et al. |
| 6,458,387 B1 | 10/2002 | Scott et al. |
| 6,458,563 B1 | 10/2002 | Lollar |
| 6,485,726 B1 | 11/2002 | Blumberg et al. |
| 6,514,532 B2 | 2/2003 | Rudnic et al. |
| 6,517,859 B1 | 2/2003 | Tice et al. |
| 6,528,624 B1 | 3/2003 | Idusogie et al. |
| 6,534,090 B2 | 3/2003 | Puthli et al. |
| 6,538,124 B1 | 3/2003 | Idusogie et al. |
| 6,572,585 B2 | 6/2003 | Choi |
| 6,669,961 B2 | 12/2003 | Kim et al. |
| 6,696,245 B2 | 2/2004 | Winter et al. |
| 6,713,086 B2 | 3/2004 | Qiu et al. |
| 6,715,485 B1 | 4/2004 | Djupesland |
| 6,733,753 B2 | 5/2004 | Boone et al. |
| 6,737,056 B1 | 5/2004 | Presta |
| 6,743,211 B1 | 6/2004 | Prausnitz et al. |
| 6,759,057 B1 | 7/2004 | Weiner et al. |
| 6,770,744 B2 | 8/2004 | Lollar |
| 6,814,979 B2 | 11/2004 | Rudnic et al. |
| 6,818,439 B1 | 11/2004 | Jolly et al. |
| 6,821,505 B2 | 11/2004 | Ward |
| 6,833,352 B2 | 12/2004 | Johannessen et al. |
| 6,838,093 B2 | 1/2005 | Burnside et al. |
| 6,890,918 B2 | 5/2005 | Burnside et al. |
| 6,905,688 B2 | 6/2005 | Rosen et al. |
| 6,911,323 B2 | 6/2005 | Persson et al. |
| 6,919,311 B2 | 7/2005 | Lenting et al. |
| 6,945,952 B2 | 9/2005 | Kwon |
| 6,960,657 B2 | 11/2005 | Persson et al. |
| 6,998,253 B1 | 2/2006 | Presta et al. |
| 7,026,524 B2 | 4/2006 | Persson et al. |
| 7,041,635 B2 | 5/2006 | Kim et al. |
| 7,045,318 B2 | 5/2006 | Ballance |
| 7,083,784 B2 | 8/2006 | Dall'Acqua et al. |
| 7,091,321 B2 | 8/2006 | Gillies et al. |
| 7,125,841 B2 | 10/2006 | Sheehan |
| 7,138,505 B1 | 11/2006 | Kuo et al. |
| 7,176,288 B2 | 2/2007 | Persson et al. |
| 7,199,223 B2 | 4/2007 | Bossard et al. |
| 7,211,559 B2 | 5/2007 | Saenko et al. |
| 7,276,475 B2 | 10/2007 | DeFrees et al. |
| 7,276,593 B2 | 10/2007 | Vernet |
| 7,294,513 B2 | 11/2007 | Wyatt |
| 7,317,091 B2 | 1/2008 | Lazar et al. |
| 7,329,640 B2 | 2/2008 | Vlasuk |
| 7,348,004 B2 | 3/2008 | Peters et al. |
| 7,404,956 B2 | 7/2008 | Peters et al. |
| 7,413,537 B2 | 8/2008 | Ladner et al. |
| 7,414,022 B2 | 8/2008 | Pedersen et al. |
| 7,442,778 B2 | 10/2008 | Gegg et al. |
| 7,452,967 B2 | 11/2008 | Bertin |
| 7,507,406 B2 | 3/2009 | Gillies et al. |
| 7,511,024 B2 | 3/2009 | Pedersen et al. |
| 7,514,257 B2 | 4/2009 | Lee et al. |
| 7,528,242 B2 | 5/2009 | Anderson et al. |
| 7,560,107 B2 | 7/2009 | Lollar |
| 7,566,701 B2 | 7/2009 | Diener et al. |
| 7,632,921 B2 | 12/2009 | Pan et al. |
| 7,645,860 B2 | 1/2010 | Turecek et al. |
| 7,700,733 B2 | 4/2010 | Haaning et al. |
| 7,700,734 B2 | 4/2010 | Lin et al. |
| 7,786,070 B2 | 8/2010 | Johannessen et al. |
| 7,790,415 B2 | 9/2010 | Gillies et al. |
| 7,846,445 B2 | 12/2010 | Schellenberger et al. |
| 7,846,455 B2 | 12/2010 | Collins et al. |
| 7,855,279 B2 | 12/2010 | Schellenberger et al. |
| 7,862,820 B2 | 1/2011 | Peters et al. |
| 7,884,075 B2 | 2/2011 | Scheiflinger et al. |
| 7,939,632 B2 | 5/2011 | Metzner et al. |
| 8,357,779 B2 | 1/2013 | Scheiflinger et al. |
| 8,492,530 B2 | 7/2013 | Schellenberger et al. |
| 8,563,521 B2 | 10/2013 | Skerra et al. |

(56) References Cited

U.S. PATENT DOCUMENTS

| | | |
|---|---|---|
| 8,575,104 B2 | 11/2013 | Weimer et al. |
| 8,673,860 B2 | 3/2014 | Schellenberger et al. |
| 8,680,050 B2 | 3/2014 | Schellenberger et al. |
| 8,703,717 B2 | 4/2014 | Schellenberger et al. |
| 8,716,448 B2 | 5/2014 | Schellenberger et al. |
| 8,754,194 B2 | 6/2014 | Schulte et al. |
| 8,835,388 B2 | 9/2014 | Scheiflinger et al. |
| 8,933,197 B2 | 1/2015 | Stemmer et al. |
| 9,168,312 B2 | 10/2015 | Schellenberger et al. |
| 9,376,672 B2 | 6/2016 | Schellenberger et al. |
| 2002/0042079 A1 | 4/2002 | Simon et al. |
| 2002/0150881 A1 | 10/2002 | Ladner et al. |
| 2003/0049689 A1 | 3/2003 | Edwards et al. |
| 2003/0069395 A1 | 4/2003 | Sato et al. |
| 2003/0181381 A1 | 9/2003 | Himmelspach et al. |
| 2003/0190740 A1 | 10/2003 | Altman |
| 2003/0228309 A1 | 12/2003 | Salcedo et al. |
| 2003/0235536 A1 | 12/2003 | Richard et al. |
| 2004/0043446 A1 | 3/2004 | DeFrees et al. |
| 2004/0101740 A1 | 5/2004 | Sanders |
| 2004/0106118 A1 | 6/2004 | Kolmar et al. |
| 2004/0192599 A1 | 9/2004 | Schuh et al. |
| 2004/0203107 A1 | 10/2004 | Murray |
| 2004/0259780 A1 | 12/2004 | Glasebrook et al. |
| 2005/0042721 A1 | 2/2005 | Fang et al. |
| 2005/0048512 A1 | 3/2005 | Kolkman et al. |
| 2005/0100990 A1 | 5/2005 | Saenko et al. |
| 2005/0118136 A1 | 6/2005 | Leung et al. |
| 2005/0123997 A1 | 6/2005 | Lollar |
| 2005/0147618 A1 | 7/2005 | Rivera et al. |
| 2005/0260605 A1 | 11/2005 | Punnonen et al. |
| 2005/0287153 A1 | 12/2005 | Dennis |
| 2006/0026719 A1 | 2/2006 | Kieliszewski et al. |
| 2006/0040856 A1 | 2/2006 | DeFrees et al. |
| 2006/0074199 A1 | 4/2006 | Hirata et al. |
| 2006/0084113 A1 | 4/2006 | Ladner et al. |
| 2006/0115876 A1 | 6/2006 | Pan et al. |
| 2006/0122376 A1 | 6/2006 | Chapman et al. |
| 2006/0205036 A1 | 9/2006 | Ostergaard et al. |
| 2006/0211621 A1 | 9/2006 | Knudsen et al. |
| 2006/0287220 A1 | 12/2006 | Li et al. |
| 2006/0293232 A1 | 12/2006 | Levy et al. |
| 2006/0293238 A1 | 12/2006 | Kaufman et al. |
| 2007/0021494 A1 | 1/2007 | Taveras et al. |
| 2007/0048282 A1 | 3/2007 | Rosen et al. |
| 2007/0161087 A1 | 7/2007 | Glaesner et al. |
| 2007/0191272 A1 | 8/2007 | Stemmer et al. |
| 2007/0191597 A1 | 8/2007 | Jain et al. |
| 2007/0203058 A1 | 8/2007 | Lau et al. |
| 2007/0212703 A1 | 9/2007 | Stemmer et al. |
| 2007/0231329 A1 | 10/2007 | Lazar et al. |
| 2007/0237765 A1 | 10/2007 | Lazar et al. |
| 2007/0237766 A1 | 10/2007 | Lazar et al. |
| 2007/0237767 A1 | 10/2007 | Lazar et al. |
| 2007/0243188 A1 | 10/2007 | Lazar et al. |
| 2007/0244301 A1 | 10/2007 | Siekmann et al. |
| 2007/0248603 A1 | 10/2007 | Lazar et al. |
| 2007/0286859 A1 | 12/2007 | Lazar et al. |
| 2008/0004206 A1 | 1/2008 | Rosen et al. |
| 2008/0033413 A1 | 2/2008 | Inochkin et al. |
| 2008/0039341 A1 | 2/2008 | Schellenberger et al. |
| 2008/0057056 A1 | 3/2008 | Lazar et al. |
| 2008/0146782 A1 | 6/2008 | DeFrees et al. |
| 2008/0153751 A1 | 6/2008 | Rosen et al. |
| 2008/0161243 A1 | 7/2008 | Rosen et al. |
| 2008/0167219 A1 | 7/2008 | Lin et al. |
| 2008/0167238 A1 | 7/2008 | Rosen et al. |
| 2008/0176288 A1 | 7/2008 | Leung et al. |
| 2008/0193441 A1 | 8/2008 | Trown et al. |
| 2008/0194481 A1 | 8/2008 | Rosen et al. |
| 2008/0214462 A1 | 9/2008 | Dockal et al. |
| 2008/0227691 A1 | 9/2008 | Ostergaard et al. |
| 2008/0233100 A1 | 9/2008 | Chen et al. |
| 2008/0234193 A1 | 9/2008 | Bossard et al. |
| 2008/0255040 A1 | 10/2008 | DeFrees |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0011992 A1 | 1/2009 | Olsen et al. |
| 2009/0042787 A1 | 2/2009 | Metzner et al. |
| 2009/0058322 A1 | 3/2009 | Toma et al. |
| 2009/0060862 A1 | 3/2009 | Chang et al. |
| 2009/0087411 A1 | 4/2009 | Fares et al. |
| 2009/0092582 A1 | 4/2009 | Stemmer et al. |
| 2009/0099031 A1 | 4/2009 | Stemmer et al. |
| 2009/0117104 A1 | 5/2009 | Baker et al. |
| 2009/0118185 A1 | 5/2009 | Fay et al. |
| 2009/0169553 A1 | 7/2009 | Day |
| 2009/0192076 A1 | 7/2009 | Matthiessen et al. |
| 2009/0250598 A1 | 10/2009 | Hamada et al. |
| 2009/0263380 A1 | 10/2009 | Gilles et al. |
| 2010/0022445 A1 | 1/2010 | Scheiflinger et al. |
| 2010/0081187 A1 | 4/2010 | Griffith et al. |
| 2010/0081615 A1 | 4/2010 | Pan et al. |
| 2010/0120664 A1* | 5/2010 | Schulte ............ C07K 14/745 514/13.7 |
| 2010/0130427 A1 | 5/2010 | Bossard et al. |
| 2010/0143326 A1 | 6/2010 | Rischel et al. |
| 2010/0189682 A1 | 7/2010 | Schellenberger et al. |
| 2010/0239554 A1* | 9/2010 | Schellenberger .... C07K 14/001 424/94.3 |
| 2010/0260706 A1 | 10/2010 | Bogin et al. |
| 2010/0285021 A1 | 11/2010 | Jacquemin et al. |
| 2010/0292130 A1 | 11/2010 | Skerra et al. |
| 2010/0323956 A1 | 12/2010 | Schellenberger et al. |
| 2011/0046060 A1 | 2/2011 | Schellenberger et al. |
| 2011/0046061 A1 | 2/2011 | Schellenberger et al. |
| 2011/0077199 A1 | 3/2011 | Schellenberger et al. |
| 2011/0124565 A1 | 5/2011 | Hauser et al. |
| 2011/0151433 A1 | 6/2011 | Schellenberger et al. |
| 2011/0172146 A1 | 7/2011 | Schellenberger et al. |
| 2011/0183907 A1 | 7/2011 | Weimer et al. |
| 2011/0286988 A1 | 11/2011 | Jiang et al. |
| 2011/0287041 A1 | 11/2011 | Carrico et al. |
| 2011/0287517 A1 | 11/2011 | Steward et al. |
| 2011/0288005 A1 | 11/2011 | Silverman et al. |
| 2011/0312881 A1 | 12/2011 | Silverman et al. |
| 2012/0065077 A1 | 3/2012 | Astermark et al. |
| 2012/0121706 A1 | 5/2012 | Kuliopulos et al. |
| 2012/0142593 A1 | 6/2012 | Zhao et al. |
| 2012/0178691 A1 | 7/2012 | Schellenberger et al. |
| 2012/0220011 A1 | 8/2012 | Schellenberger et al. |
| 2012/0230947 A1 | 9/2012 | Schellenberger et al. |
| 2012/0263701 A1 | 10/2012 | Schellenberger et al. |
| 2012/0263703 A1 | 10/2012 | Schellenberger et al. |
| 2012/0289468 A1 | 11/2012 | Barnett |
| 2013/0017997 A1* | 1/2013 | Schellenberger .... C07K 14/755 514/14.1 |
| 2013/0039884 A1 | 2/2013 | Bogin et al. |
| 2013/0108629 A1 | 5/2013 | Dumont et al. |
| 2013/0165389 A1 | 6/2013 | Schellenberger et al. |
| 2013/0172274 A1 | 7/2013 | Chilkoti |
| 2013/0183280 A1 | 7/2013 | Oestergaard et al. |
| 2014/0018297 A1 | 1/2014 | Bolt et al. |
| 2014/0050693 A1 | 2/2014 | Skerra et al. |
| 2014/0072561 A1 | 3/2014 | Weimer et al. |
| 2014/0186327 A1 | 7/2014 | Schellenberger et al. |
| 2014/0273096 A1 | 9/2014 | Schulte et al. |
| 2014/0301974 A1 | 10/2014 | Schellenberger et al. |
| 2014/0328819 A1 | 11/2014 | Schellenberger et al. |
| 2014/0356326 A1 | 12/2014 | Schellenberger et al. |
| 2014/0371136 A1 | 12/2014 | Schellenberger et al. |
| 2015/0023959 A1 | 1/2015 | Chhabra et al. |
| 2015/0038421 A1 | 2/2015 | Schellenberger et al. |
| 2015/0158929 A1 | 6/2015 | Schellenberger et al. |
| 2015/0175503 A1 | 6/2015 | Marks et al. |
| 2015/0259431 A1 | 9/2015 | Stemmer et al. |
| 2015/0266943 A1 | 9/2015 | Chhabra et al. |
| 2015/0328819 A1 | 11/2015 | Schellenberger et al. |
| 2015/0344862 A1 | 12/2015 | Schellenberger et al. |
| 2016/0115467 A1 | 4/2016 | Salas |
| 2016/0229903 A1 | 8/2016 | Chhabra et al. |

(56) References Cited

U.S. PATENT DOCUMENTS

| | | |
|---|---|---|
| 2016/0251408 A1 | 9/2016 | Chhabra et al. |
| 2016/0376344 A1 | 12/2016 | Schellenberger et al. |
| 2017/0073393 A1 | 3/2017 | Chhabra et al. |

FOREIGN PATENT DOCUMENTS

| | | | |
|---|---|---|---|
| CN | 101190945 A | 6/2008 | |
| EP | 0036776 A2 | 9/1981 | |
| EP | 0154316 A2 | 9/1985 | |
| EP | 0184438 A2 | 6/1986 | |
| EP | 0238023 A2 | 9/1987 | |
| EP | 0244234 A2 | 11/1987 | |
| EP | 0272277 A1 | 6/1988 | |
| EP | 0295597 A2 | 12/1988 | |
| EP | 0401384 A1 | 12/1990 | |
| EP | 0272277 B1 | 9/1993 | |
| EP | 1203014 B1 | 10/2004 | |
| EP | 0506757 B2 | 10/2005 | |
| EP | 1252192 B1 | 8/2006 | |
| EP | 1935430 A1 | 6/2008 | |
| EP | 2256135 A1 | 12/2010 | |
| EP | 2173890 B1 | 3/2011 | |
| EP | 2371856 A2 | 10/2011 | |
| EP | 2032607 B1 | 1/2014 | |
| EP | 2796145 A1 | 10/2014 | |
| WO | WO-8704187 A1 | 7/1987 | |
| WO | WO-8800831 A1 | 2/1988 | |
| WO | WO-8803558 A1 | 5/1988 | |
| WO | WO-8807089 A1 | 9/1988 | |
| WO | WO-8807220 A1 | 9/1988 | |
| WO | WO-8808035 A1 | 10/1988 | |
| WO | WO-8909051 A1 | 10/1989 | |
| WO | WO-9109122 A1 | 6/1991 | |
| WO | WO-9210576 A1 | 6/1992 | |
| WO | WO-9216221 A1 | 10/1992 | |
| WO | WO-9320093 A1 | 10/1993 | |
| WO | WO-9411503 A2 | 5/1994 | |
| WO | WO-9534326 A1 | 12/1995 | |
| WO | WO-9614339 A1 | 5/1996 | |
| WO | WO-9733552 A1 | 9/1997 | |
| WO | WO-9805787 A1 | 2/1998 | |
| WO | WO-9822577 A1 | 5/1998 | |
| WO | WO-9823289 A1 | 6/1998 | |
| WO | WO-9852976 A1 | 11/1998 | |
| WO | WO-9941383 A1 | 8/1999 | |
| WO | WO-9949901 A1 | 10/1999 | |
| WO | WO-9951642 A1 | 10/1999 | |
| WO | WO-9958572 A1 | 11/1999 | |
| WO | WO-0003317 A1 | 1/2000 | |
| WO | WO-0009560 A2 | 2/2000 | |
| WO | WO-0032767 A1 | 6/2000 | |
| WO | WO-0042072 A2 | 7/2000 | |
| WO | WO-0187922 A2 | 11/2001 | |
| WO | WO-0244215 A2 | 6/2002 | |
| WO | WO-02060919 A2 | 8/2002 | |
| WO | WO-02077036 A2 | 10/2002 | |
| WO | WO-02079232 A2 | 10/2002 | |
| WO | WO-03074569 A2 | 9/2003 | |
| WO | WO-03077834 A2 | 9/2003 | |
| WO | WO-2004016750 A2 | 2/2004 | |
| WO | WO-2004029207 A2 | 4/2004 | |
| WO | WO-2004035752 A2 | 4/2004 | |
| WO | WO-2004044859 A1 | 5/2004 | |
| WO | WO-2004063351 A2 | 7/2004 | |
| WO | WO-2004074455 A2 | 9/2004 | |
| WO | WO-2004099249 A2 | 11/2004 | |
| WO | WO-2005016455 A2 | 2/2005 | |
| WO | WO-2005025499 A2 | 3/2005 | |
| WO | WO-2005040217 A2 | 5/2005 | |
| WO | WO-2005047327 A2 | 5/2005 | |
| WO | WO-2005069845 A2 | 8/2005 | |
| WO | WO-2005070963 A1 | 8/2005 | |
| WO | WO-2005077981 A2 | 8/2005 | |
| WO | WO-2005092925 A2 | 10/2005 | |
| WO | WO-2005123780 A2 | 12/2005 | |
| WO | WO-2006019447 A1 | 2/2006 | |
| WO | WO-2006047350 A2 | 5/2006 | |
| WO | WO-2006053299 A2 | 5/2006 | |
| WO | WO-2006081249 A2 | 8/2006 | |
| WO | WO-2006085967 A2 | 8/2006 | |
| WO | WO-2006081249 A3 | 2/2007 | |
| WO | WO-2007021494 A2 | 2/2007 | |
| WO | WO-2007073486 A2 | 6/2007 | |
| WO | WO-2007090584 A1 | 8/2007 | |
| WO | WO-2007103455 A2 | 9/2007 | |
| WO | WO-2007103515 A2 | 9/2007 | |
| WO | WO-2007103455 A3 | 11/2007 | |
| WO | WO 2007/144173 A1 | 12/2007 | |
| WO | WO-2008033413 A2 | 3/2008 | |
| WO | WO-2008049931 A1 | 5/2008 | |
| WO | WO-2008057683 A2 | 5/2008 | |
| WO | WO-2008077616 A1 | 7/2008 | |
| WO | WO-2008155134 A1 | 12/2008 | |
| WO | WO-2009023270 A2 | 2/2009 | |
| WO | WO-2009023270 A3 | 2/2009 | |
| WO | WO-2009058322 A1 | 5/2009 | |
| WO | WO-2009062100 A1 | 5/2009 | |
| WO | WO-2009149303 A1 | 12/2009 | |
| WO | WO-2009156137 A1 | 12/2009 | |
| WO | WO-2010060081 A1 | 5/2010 | |
| WO | WO-2010062768 A1 | 6/2010 | |
| WO | WO-2010091122 A1 | 8/2010 | |
| WO | WO 2010091122 A1 * | 8/2010 | ........... C07K 14/001 |
| WO | WO 2010111414 A1 * | 9/2010 | ........... C07K 14/755 |
| WO | WO-2010111414 A1 | 9/2010 | |
| WO | WO-2010144502 A2 | 12/2010 | |
| WO | WO-2010144508 A1 | 12/2010 | |
| WO | WO-2011020866 A2 | 2/2011 | |
| WO | WO-2011028228 A1 | 3/2011 | |
| WO | WO-2011028229 A1 | 3/2011 | |
| WO | WO-2011028344 A2 | 3/2011 | |
| WO | WO-2011060242 A2 | 5/2011 | |
| WO | WO 2011069164 A2 * | 6/2011 | ............. A61K 38/37 |
| WO | WO-2011069164 A2 | 6/2011 | |
| WO | WO-2011084808 A2 | 7/2011 | |
| WO | WO-2011101242 A1 | 8/2011 | |
| WO | WO-2011101284 A1 | 8/2011 | |
| WO | WO-2011123813 A2 | 10/2011 | |
| WO | WO-2012006623 A2 | 1/2012 | |
| WO | WO-2012006624 A2 | 1/2012 | |
| WO | WO-2012006633 A1 | 1/2012 | |
| WO | WO-2012006635 A1 | 1/2012 | |
| WO | WO-2012007324 A2 | 1/2012 | |
| WO | WO-2012170969 A2 | 12/2012 | |
| WO | WO-2013106787 A1 | 7/2013 | |
| WO | WO-2013122617 A1 | 8/2013 | |
| WO | WO-2013123457 A1 | 8/2013 | |
| WO | WO-2013160005 A1 | 10/2013 | |
| WO | WO-2014011819 A2 | 1/2014 | |
| WO | WO-2014101287 A1 | 7/2014 | |
| WO | WO-2014173873 A1 | 10/2014 | |
| WO | WO-2014194282 A2 | 12/2014 | |
| WO | WO-2014198699 A2 | 12/2014 | |
| WO | WO-2014210547 A1 | 12/2014 | |
| WO | WO-2014210558 A1 | 12/2014 | |
| WO | WO-2015023891 A2 | 2/2015 | |
| WO | WO-2015106052 A1 | 7/2015 | |

OTHER PUBLICATIONS

Ackerman, M.J. and Clapham, D.E., "Ion Channels—Basic Science and Clinical Disease," The New England Journal of Medicine 336(22):1575-1586, Boston, Mass. Med. Soc., United States (1997).

Adams, G.P., et, al., "High Affinity Restricts the Localization and Tumor Penetration of Single-Chain Fv Antibody Molecules," Cancer Res. 61(12):4750-55, Am. Assoc. Cancer Res., United States (2001).

Adams, GP., et al., "Increased Affinity Leads to Improved Selective Tumor Delivery of Single-Chain Fv Antibodies," Cancer research 58(3):485-490, Am. Assoc. Cancer Res., United States (1998).

Agersoe, H., et al., "Prolonged effect of N8-Gp in haemophilia A dogs supports less frequent dosing," Journal of Thrombosis and

(56) References Cited

OTHER PUBLICATIONS

Haemostasis 9(Suppl. 2): P-MO-181, ISTH Meeting, International Society on Thrombosis and Haemostasis, United States (2011).

Ahmad, S., et al., "ASAView: Database and tool for solvent accessibility representation in proteins," BMC Bioinformatics 5:51:1-5, BioMed Central, England (2004).

Alam, K.S., et al., "Expression and Purification of a Mutant Human Growth Hormone That is Resistant to Proteolytic Cleavage by Thrombin, Plasmin and Human Plasma in Vitro," Journal of Biotechnology 65(2-3):183-190, Elsevier Science Publishers, Netherlands (1998).

Alber, T. and Kawasaki, G., "Nucleotide Sequence of the Triose Phosphate Isomerase Gene of *Saccharomyces cerevisiae*," Journal of Molecular and Applied Genetics 1(5):419-434, Raven Press, United States (1982).

Algiman, M., et al., "Natural antibodies to factor VIII (anti-hemophilic factor) in healthy individuals," Proceedings of the National Academy of Sciences 89(9):3795-3799, National Academy of Sciences, United States (1992).

Altschul, S.F., et al., "Basic Local Alignment Search Tool," Journal of Molecular Biology 215(3):403-410, Academic Press Limited, England (1990).

Alvarez, P., et al., "Improving Protein Pharmacokinetics by Genetic Fusion to Simple Amino Acid Sequences," Journal of Biological Chemistry 279(5):3375-3381, The American Society for Biochemistry and Molecular Biology, Inc., United States (2004).

Amin, N., et al., "Construction of Stabilized Proteins by Combinatorial Consensus Mutagenesis," Protein Engineering, Design & Selection : PEDS 17(11):787-793, Oxford University Press, England (2004).

Ansong, C., et al., "Epitope mapping factor VIII A2 domain by affinity-directed mass spectrometry: residues 497-510 and 584-593 comprise a discontinuous epitope for the monoclonal antibody R8B12," Journal of Thrombosis and Haemostasis 4(4):842-847, Blackwell Publishing Ltd., England (2006).

Antcheva, N., et al., "Proteins of Circularly Permuted Sequence Present Within the Same Organism: the Major Serine Proteinase inhibitor from Capsicum Annuum Seeds," Protein Science : a Publication of the Protein Society 10(11):2280-2290, Cold Spring Harbor Laboratory Press, United States (2001).

Appa, R., et al., "Investigating clearance mechanisms for recombinant activated factor VII in a perfused liver model," Journal of Thrombosis and Haemostasis 104(2):243-251, Stuttgart, Schattauer, Germany (Aug. 2010).

"Approval Letter—NovoSeven," U.S. Food and Drug Administration, Department of Health and Human Services, FDA Reference No. 96-0597, accessed at http://www.fda.gov/BiologicsBloodVaccines/BloodBloodProducts/ApprovedProducts/LicensedProductsBLAs/FractionatedPlasmaProducts/ucm056916.htm#, accessed on Dec. 12, 2014, 2 pages.

Araki, K., et al., "Four Disulfide Bonds' Allocation of Na+, K(+)-Atpase inhibitor (Spai)," Biochemical and Biophysical Research Communications 172(1):42-46, Academic Press, United States (1990), Abstract only.

Arap, W., et al., "Steps Toward Mapping the Human Vasculature by Phage Display," Nature medicine 8(2):121-127, Nature Publishing Company, United States (2002).

Armour, K.L., et al., "Recombinant Human IgG Molecules Lacking Fcγ Receptor I Binding and Monocyte Triggering Activities," European Journal of Immunology 29(8):2613-2624, Wiley-VCH, Germany (1999).

Arnau, J., et al., "Current strategies for the use of affinity tags and tag removal for the purification of recombinant proteins," Protein Expression and Purification 48(1):1-13, Elsevier Inc., United States (2006).

Arndt, K.M., et al., "Factors Influencing the Dimer to Monomer Transition of an Antibody Single-Chain Fv Fragment," Biochemistry 37:12918-12926, American Chemical Society, United States (1998).

Arruda, V.R., et al., "Posttranslational modifications of recombinant myotube-synthesized human factor IX," Blood 97(1):130-138, The American Society of Hematology, United States (2001).

Assadi-Porter, F.M., et al., "Sweetness Determinant Sites of Brazzein, A Small, Heat-Stable, Sweet-Tasting Protein," Archives of Biochemistry and Biophysics 376(2):259-265, Academic Press, United States (2000).

Aster, J.C., et al., "The Folding and Structural integrity of the First Lin-12 Module of Human Notch1 are Calcium-Dependent," Biochemistry 38(15):4736-4742, Washington, American Chemical Society., United States (1999).

Peters, R.T., et al., "Biochemical and functional characterization of a recombinant monomeric factor VIII-Fc fusion protein," Journal of Thrombosis and Haemostasis 11:132-141, International Society on Thrombosis and Haemostasis, England (2012).

Bachmann, M.F., et al., "T helper cell-independent neutralizing B cell response against vesicular stomatitis virus: role of antigen patterns in B cell induction?," European Journal of Immunology 25(12):3445-3451, Wiley-VCH Verlag GmbH, Germany (1995).

Bailon, P., et al., "Rational design of a potent, long-lasting form of interferon: a 40 kDa branched polyethylene glycol-conjugated interferon alpha-2a for the treatment of hepatitis C," Bioconjugate Chemistry 12(2):195-202, American Chemical Society, United States (2001).

Bajaj, S.P. and Birktoft, J.J., "Human factor IX and Factor IXa," Methods in Enzymology 222:96-128, Academic Press, Inc., England (1993).

Baneyx, F. and Mujacic, M., "Recombinant Protein Folding and Misfolding in *Escherichia coli*," Nature Biotechnology 22(11):1399-1408, Nature America Publishing, United States (2004).

Baron, E., "From cloning to a commercial realization: human alpha interferon," Critical Reviews in Biotechnology 10(3):179-190, CRC Press, Ltd, United States (1990).

Barrowcliffe, T.W., et al., "Coagulation and Chromogenic Assays of Factor VIII Activity: General Aspects, Standardization, and Recommendations," Seminars in Thrombosis and Hemostasis 28(3):247-256, Thieme Medical Publishers, Inc., United States (2002).

Barta, E., et al., "Repeats With Variations: Accelerated Evolution of the Pin2 Family of Proteinase inhibitors," Trends in Genetics 18(12):600-603, Elsevier Trends Journals, England (2002).

Bateman, A. and Bennett, H.P., "Granulins : the Structure and Function of an Emerging Family of Growth Factors," The Journal of Endocrinology 158(2):145-151, BioScientifica, England (1998).

Beissinger, M. and Buchner, J., "How Chaperones Fold Proteins," Biological Chemistry 379(3):245-259, Walter De Gruyter, Germany (1998).

Belaaouaj, A.A., et al., "Matrix Metalloproteinases Cleave Tissue Factor Pathway Inhibitor: Effects on coagulation," The Journal of Biological Chemistry 275(35):27123-27128, The American Society for Biochemistry and Molecular Biology, Inc., United States (2000).

Belew, M., et al., "Purification of recombinant human granulocyte-macrophage colony-stimulating factor from the inclusion bodies produced by transformed *Escherichia coli* cells," Journal of Chromatography 679(1):67-83, Elsevier, Netherlands (1994).

Benhar, I. and Pastan, I., "Cloning, Expression and Characterization of the Fv Fragments of the Anti-Carbohydrate mAbs B1 and B5 as Single-Chain Immunotoxins," Protein Engineering Design and Selection 7(11):1509-1515, Oxford University Press, England (1994).

Bensch, K,W., et al., "Hbd-1: A Novel Beta-Defensin from Human Plasma," FEBS Letters 368(2):331-335, Elsevier Science B.V, Netherlands (1995).

Berger, S.L., et al., "Phoenix Mutagenesis: One-Step Reassembly of Multiply Cleaved Plasmids With Mixtures of Mutant and Wild-Type Fragments," Analytical Biochemistry 214(2):571-579, Academic Press, United States (1993).

Beste, G., et al., "Small Antibody-like Proteins with Prescribed Ligand Specificities Derived from the Lipocalin Fold," Proceedings of the National Academy of Sciences 96(5):1898-1903, National Academy of Sciences, United States (1999).

Binz, H.K., et al., "Engineering Novel Binding Proteins from Nonimmunoglobulin Domains," Nature biotechnology 23(10):1257-1268, Nature America Publishing, United States (2005).

(56) References Cited

OTHER PUBLICATIONS

Bird, R.E., et al., "Single-Chain Antigen-Binding Proteins," Science 242(4877):423-426, Association for the Advancement of Science, United States (1988).
Bittner, B., et al., "Recombinant Human Erythropoietin (Rhepo) Loaded Poly(Lactide-Co-Glycolide) Microspheres: influence of the Encapsulation Technique and Polymer Purity on Microsphere Characteristics," European Journal of Pharmaceutics and Biopharmaceutics 45(3):295-305, Elsevier Science, Netherlands (1998).
Bjoern., S. and Thim, L., "Activation of Coagulation Factor VII to VIIa," Research Disclosure 26960:564-565, Questel Ireland Ltd., Ireland (1986).
Bjorkman, S. and Berntorp, E., "Pharmacokinetics of Coagulation Factors: Clinical Relevance for Patients with Haemophilia," Clinical Pharmacokinetics 40(11):815-832, Adis International Ltd., New Zealand (2001).
Blanchette, J., et al., "Principles of Transmucosal Delivery of therapeutic Agents," Biomedicine & Pharmacotherapy 58(3):142-151, Editions Scientifiques Elsevier, France (2004).
Bloch, C, J.R., et al., "1H Nmr Structure of an Antifungal Gamma-Thionin Protein Sialphal: Similarity to Scorpion Toxins," Proteins 32(3):334-349, Wiley-Liss, United States (1998).
Bobrow, R.S., "Excess Factor VIII: a Common Cause of Hypercoagulability," J Am Board Fam Pract 18(2):147-149, American Board of Family Medicine, United States (2005).
Bodenmuller, et al., "The Neuropeptide Head Activator Loses Its Biological Acitivity by Dimerization," The EMBO Journal 5(8):1825-1829, Wiley Blackwell, England (1986).
Boder, E.T., et al., "Directed Evolution of Antibody Fragments With Monovalent Femtomolar Antigen-Binding Affinity," Proceedings of the National Academy of Sciences of the United States of America 97(20):10701-10705, National Academy of Sciences, United States (2000).
Boshart, M., et al., "A Very Strong Enhancer is Located Upstream of an Immediate Early Gene of Human Cytomegalovirus," Cell 41(2):521-530, Cell Press, United States (1985).
Briët, E., et al., "High Titer Inhibitors in Severe Haemophilia A: A Meta-analysis Based on Eight Long-term Follow-up Studies concerning Inhibitors Associated with Crude or Intermediate Purity Factor VIII Products," Journal of Thrombosis and Haemostasis 72(1):162-164, International Society on Thrombosis and Haemostasis, England (1994).
Brooks, D.J., et al., "Evolution of Amino Acid Frequencies in Proteins Over Deep Time: inferred Order of introduction of Amino Acids into the Genetic Code," Molecular Biology and Evolution 19(10):1645-1655, Oxford University Press, United States (2002).
Buchner, J., "Supervising the Fold: Functional Principles of Molecular Chaperones," FASEB Journal 10(1):10-19, The Federation, United States (1996).
Bulaj, G., et al., "Efficient Oxidative Folding of Conotoxins and the Radiation of Venomous Cone Snails," Proceedings of the National Academy of Sciences of the United States of America 100(Suppl 2):14562-14568, National Academy of Sciences, United States (2003).
Burmeister, W.P., et al., "Crystal structure of the complex of rat neonatal Fc receptor with Fc," Nature 372(6504):379-383, Nature Publishing Group, England (1994).
Buscaglia, C.A., et al., "Tandem amino acid repeats from Trypanosoma cruzi shed antigens increase the half-life of proteins in blood," Blood 93(6):2025-2032, American Society of Hematology, United States (1999).
Calabrese, J.C., et al., "Crystal Structure of Phenylalanine Ammonia Lyase: Multiple Helix Dipoles Implicated in Catalysis," Biochemistry 43(36):11403-11416, Washington, American Chemical Society, United States (2004).
Caliceti, P. and Veronese, F.M., "Pharmacokinetic and biodistribution properties of poly(ethylene glycol)-protein conjugates," Advanced Drug Delivery Reviews 55(10):1261-1277, Elsevier B.V., Netherlands (2003).
Caliceti, P., et al., "Biopharmaceutical Properties of Uricase Conjugated to Neutral and Amphiphilic Polymers," Bioconjugate Chemistry 10(4):638-646, American Chemical Society, United States (1999).
Calvete, J.J., et al., "Disulphide-Bond Pattern and Molecular Modelling of the Dimeric Disintegrin Emf-10 , A Potent and Selective integrin Alpha5Beta1 Antagonist from Eristocophis Macmahoni Venom," The Biochemical Journal 345(Pt 3):573-581, Published by Portland Press on behalf of the Biochemical Society, England (2000).
Calvete, J.J., et al., "Snake Venom Disintegrins: Evolution of Structure and Function," Toxicon 45(8):1063-1074, Pergamon Press, England (2005).
Calvete, J.J., et al., "Snake Venom Disintegrins: Novel Dimeric Disintegrins and Structural Diversification by Disulphide Bond Engineering," The Biochemical Journal 372(Pt 3):725-734, Published by Portland Press on behalf of the Biochemical Society, London (2003).
Cameron, C., et al., "The Canine Factor VIII cDNA and 5' Flanking Sequence," Thrombosis and Haemostasis 79(2):317-322, Schattauer Verlag, Germany (1998).
Cao, P., et al., "Development of a Compact Anti-Baff Antibody in *Escherichia coli*," Applied Microbiology and Biotechnology 73(1):151-157, Springer International, Germany (2006).
Capon, D.J., et al., "Designing CD4 Immunoadhesins for AIDS Therapy," Nature 337(6207):525-531, Nature Publishing Group, England (1989).
Carr, M.D., et al., "Solution Structure of a Trefoil-Motif-Containing Cell Growth Factor, Porcine Spasmolytic Protein," Proceedings of the National Academy of Sciences of the United States of America 91(6):2206-2210, National Academy of Sciences, United States (1994).
Castor, B., et al., "Septic Cutaneous Lesions Caused by *Mycobacterium malmoense* in a Patient With Hairy Cell Leukemia," European Journal of Clinical Microbiology & Infectious Diseases 13(2):145-148, Springer, Germany (1994).
Chang, A.C.Y., et al., "Phenotypic expression in *E. coli* of a DNA sequence coding for mouse dihydrofolate reductase," Nature 275(5681):617-624, MacMillan Journals Ltd, United States (1978).
Chen, L.H., et al., "Expression, Purification, And in Vitro Refolding of a Humanized Single-Chain Fv Antibody Against Human Ctla4 (Cd152)," Protein Expression and Purification 46(2):495-502, Academic Press, United States (2006).
Chen, L.Q., et al., "Crystal Structure of a Bovine Neurophysin Ii Dipeptide Complex At 2," Proceedings of the National Academy of Sciences of the United States of America 88(10):4240-4244, National Academy of Sciences, United States (1991).
Chen, X.J., et al., "Site-Directed Mutations in a Highly Conserved Region of Bacillus Thuringiensis Delta-Endotoxin Affect inhibition of Short Circuit Current Across Bombyx Mori Midguts," Proceedings of the National Academy of Sciences of the United States of America 90(19):9041-9045, National Academy of Sciences, United States (1993).
Chirino, A.J., et al., "Minimizing the Immunogenicity of Protein therapeutics," Drug Discovery Today 9(2):82-90, Elsevier Science Ltd., England (2004).
Cho, J.W. and Troy, F.A. II, "Polysialic Acid Engineering: Synthesis of Polysialylated Neoglycosphingolipids by using the Polysialyltransferase from Neuroinvasive *Escherichia coli* K1," Proceedings of the National Academy of Sciences USA 91(24):11427-11431, National Academy of Sciences, United States (1994).
Chong, J.M. and Speicher, D.W., "Determination of Disulfide Bond assignments and N-Glycosylation Sites of the Human Gastrointestinal Carcinoma. Antigen Ga733-2 (Co17-1A, Egp, Ksl-4, Ksa, and Ep-Cam)," The Journal of Biological Chemistry 276(8):5804-5813, American Society for Biochemistry and Molecular Biology, United States (2001).
Chong, J.M., et al., "Disulfide Bond assignments of Secreted Frizzled-Related Protein-1 Provide insights About Frizzled Homology and Netrin Modules," The Journal of Biological Chemistry 277(7):5134-5144, American Society for Biochemistry and Molecular Biology, United States (2002).

(56) References Cited

OTHER PUBLICATIONS

Choo, K.H., et al., "Molecular Cloning of the Gene for Human Anti-haemophilic Factor IX," Nature 299(5879):178-180, Macmillan Journals Ltd., England (1982).
Chou, P.Y., "Prediction of protein conformation," Biochemistry 13(2):222-245, The American Chemical Society, United States (1974).
Chowdhury, P.S. and Pastan, I., "Improving antibody affinity by mimicking somatic hypermutation in vitro," Nature Biotechnology 17(6):568-572, Nature Publishing Group, United States (1999).
Christmann, A., et al., "The Cystine Knot of a Squash-Type Protease inhibitor as a Structural Scaffold for *Escherichia coli* Cell Surface Display of Conformationally Constrained Peptides," Protein Engineering 12(9):797-806, Oxford University Press, England (1999).
Clark, R., et al., "Long-acting growth hormones produced by conjugation with polyethylene glycol," Journal of Biological Chemistry 271(36):21969-21977, The American Society for Biochemistry and Molecular Biology, Inc., United States (1996).
Clark, R.G., et al., "Recombinant Human Growth Hormone (Gh )-Binding Protein Enhances the Growth-Promoting Activity of Human Gh in the Rat," Endocrinology 137(10):4308-4315, Endocrine Society, United States (1996).
Cleland, J.L., et al., "An Extended Half-life Exenatide Construct for Weekly Administration in the Treatment of Diabetes Mellitus," Diabetes 58:A511-A512, American Diabetes Association, United States (2009).
Cleland, J.L., et al., "Emerging Protein Delivery Methods," Current Opinion in Biotechnology 12(2):212-219, Elsevier, England (2001).
Coia, G., et al., "Use of Mutator Cells as a Means for increasing Production Levels of a Recombinant Antibody Directed Against Hepatitis B," Gene 201(1-2):203-209, Elsevier/North-Holland, Netherlands (1997).
Collen, D., et al., "Polyethylene Glycol-Derivatized Cysteine-Substitution Variants of Recombinant Staphylokinase for Single-Bolus Treatment of Acute Myocardial Infarction," Circulation 102(15):1766-1772, American Heart Association, United States (2000).
Conticello, S.G., et al., "Mechanisms for Evolving Hypervariability: the Case of Conopeptides," Molecular Biology and Evolution 18(2):120-131, Oxford University Press, United States (2001).
Saenko, E.L., et al., "A Role for the C2 Domain of Factor VIII in Bniding to von Willebrand Factor," The Journal of Biological Chemistry 269(15):11601-11605, The American Society for Biochemistry and Molecular Biology, Inc., United States (1994).
Saenko, E.L., et al., "The Acidic Region of the Factor VIII Light Chain and the C2 Domain Together Form the High Affinity Binding Site for von Willebrand Factor," The Journal of Biological Chemistry 272(29):18007-18014, The American Society for Biochemistry and Molecular Biology, Inc., United States (1997).
Zaveckas, M., et al., "Effect of Surface Histidine Mutations and their Number on the Partitioning and Refolding of Recombinant Human Granulocyte-Colony Stimulating Factor (Cys17Ser) in Aqueous Two-Phase Systems Containing Chelated Metal Ions," Journal of Chromatography B 852(1-2):409-419, Elsevier, Netherlands (2007).
Wasley, L.C., et al., "PACE/furin can process the vitamin K-dependent pro-factor IX precursor within the secretory pathway," J. Biol. Chem. 268(12):8458-65, Am. Soc. Biol. Chem., United States (1993).
Zhang, A.H., et al., "Factor VIII inhibitors: risk factors and methods for prevention and immune modulation," Clinical Reviews in Allergy & Immunology 37(2):114-124, Humana Press, United States (Feb. 6, 2009).
Co-pending U.S. Appl. No. 14/517,680, inventors Schellenberger, et al., filed Oct. 17, 2014 (Not Published).
Zhou Y.F., et al., "Sequence and Structure Relationships within Von Willebrand Factor," Blood 120(2):449-458, American Society of Hematology, United States (2012).
Corisdeo, S. and Wang, B., "Functional Expression and Display of an Antibody Fab Fragment in *Escherichia coli*: Study of Vector Designs and Culture Conditions," Protein Expression and Purification 34(2):270-279, Academic Press, United States (2004).
Corsaro, C.M. and Pearson M.L., "Enhancing the efficiency of DNA-mediated gene transfer in mammalian cells," Somatic Cell Genetics 7(5):603-616, Plenum Publishing Corporation, United States (1981).
Craik, D.J., et al., "Plant Cyclotides: A Unique Family of Cyclic and Knotted Proteins That Defines the Cyclic Cystine Knot Structural Motif," Journal of Molecular Biology 294(5):1327-1336, Elsevier, England (1999).
Crameri, A., et al., "Improved Green Fluorescent Protein by Molecular Evolution Using DNA Shuffling," Nature Biotechnology 14(3):315-319, Nature America Publishing, United States (1996).
Cull, M.G., et al., "Screening for receptor ligands using large libraries of peptides linked to the C terminus of the lac repressor," Proceedings of the National Academy of Sciences 89(5):1865-1869, National Academy of Sciences, United States (1992).
Cutler, J.A., et al., "The Identification and Classification of 41 novel Mutations in the Factor VIII Gene (F8C)," Human Mutation 19(3):274-278, Wiley-Liss, Inc., England (2002).
Daley, M.E., et al., "Structure and Dynamics of a Beta-Helical Antifreeze Protein," Biochemistry 41(17):5515-5525, American Chemical Society., United States (2002).
Daniel, S., et al., "Screening for Potassium Channel Modulators by a High Through-Put 86-Rubidium Efflux assay in a 96-Well Microtiter Plate," Journal of Pharmacological Methods 25(3):185-193, Elsevier/north-Holland, United States (1991).
Danner, S. and Belasco, J.G., "T7 Phage Display: A Novel Genetic Selection System for Cloning Rna-Binding Proteins from Cdna Libraries," Proceedings of the National Academy of Sciences of the United States of America 98(23):12954-12959, National Academy of Sciences, United States (2001).
D'Aquino, J.A., et al., "The magnitude of the backbone conformational entropy change in protein folding," Proteins 25(2):143-156, Wiley-Liss, Inc., England (1996).
Dattani, M.T., et al., "An investigation into the Lability of the Bioactivity of Human Growth Hormone Using the Esta Bioassay," Hormone Research 46(2):64-73, Karger, Switzerland (1996).
Dauplais, M., et al., "On the Convergent Evolution of Animal Toxins," The Journal of Biological Chemistry 272(7):4302-4309, American Society for Biochemistry and Molecular Biology, United States (1997).
De A., et al., "Crystal Structure of a Disulfide-Linked "Trefoil" Motif Found in a Large Family of Putative Growth Factors," Proceedings of the National Academy of Sciences of the United States of America 91(3):1084-1088, National Academy of Sciences, United States (1994).
De Boer, H.A., et al., "The *tac* promoter: a functional hybrid derived from the trp and lac promoters," Proceedings of the National Academy of Sciences 80(1):21-25, National Academy of Sciences, United States (1983).
De, Kruif, J., et al., "Selection and Application of Human Single Chain Fv Antibody Fragments from a Semi-Synthetic Phage Antibody Display Library With Designed Cdr3 Regions," Journal of Molecular Biology 248(1):97-105, Elsevier, England (1995).
Deckert, P.M., et al., "Pharmacokinetics and microdistribution of polyethylene glycol-modified humanized A33 antibody targeting colon cancer xenografts," International Journal of Cancer 87(3):382-390, Wiley-Liss, Inc., United States (2000).
Delgado, C., et al., "The Uses and Properties of PEG-Linked Proteins," Critical Reviews in Therapeutic Drug Carrier Systems 9(3-4):249-304, CRC Press, Inc., United States (1992).
Dennis, M.S., et al., "Albumin Binding as a General Strategy for Improving the Pharmacokinetics of Proteins," The Journal of Biological Chemistry 277(38):35035-35043, The American Society for Biochemistry and Molecular Biology, Inc., United States (2002).
Denoto, F.M., et al., "Human growth hormone DNA sequence and mRNA structure: possible alternative splicing," Nucleic Acids Research 9(15):3719-3730, IRL Press Limited, England (1981).
Der Maur, A.A., et al., "Direct in Vivo Screening of intrabody Libraries Constructed on a Highly Stable Single-Chain Frame-

(56) References Cited

OTHER PUBLICATIONS work," The Journal of Biological Chemistry 277(47):45075-45085, American Society for Biochemistry and Molecular Biology, United States (2002).

Desplancq, D., et al., "Multimerization Behaviour of Single Chain Fv Variants for the Tumour-Binding Antibody B72.3," Protein Engineering 7(8):1027-1033, Oxford University Press, England (1994).

Dhalluin, C., et al., "Structural and biophysical characterization of the 40 kDa PEG-interferon-α2a and its individual positional isomers," Bioconjugate Chemistry 16(3):504-517, American Chemical Society, United States (2005).

Di Lullo, G.A., et al., "Mapping the Ligand-Binding Sites and Disease-associated Mutations on the Most Abundant Protein in the Human, Type I Collagen," The Journal of Biological Chemistry 277(6):4223-4231, American Society for Biochemistry and Molecular Biology, United States (2002).

Diaz-Collier, J.A., et al., "Refold and characterization of recombinant tissue factor pathway inhibitor expressed in *Escherichia coli*," Thrombosis and Haemostasis 71(3):339-346, Schattauer GmbH, Germany (1994).

Dietrich, C.G., et al., "Abc of Oral Bioavailability: Transporters as Gatekeepers in the Gut," Gut 52(12):1788-1795, Stuttgart, Schattauer., Germany (2003).

Dolezal, O., et al., "Scfv Multimers of the Anti-Neuraminidase Antibody Nc10: Shortening of the Linker in Single-Chain Fv Fragment assembled in V(L) to V(H) Orientation Drives the formation of Dimers, Trimers, Tetramers and Higher Molecular Mass Multimers," Protein Engineering 13(8):565-574, Oxford University Press, England (2000).

Dooley, H., et al., "Stabilization of Antibody Fragments in Adverse Environments," Biotechnology and Applied Biochemistry 28 (Pt 1):77-83, Wiley-Blackwell, United States (1998).

Doyle, D.A., et al., "Crystal Structures of a Complexed and Peptide-Free Membrane Protein-Binding Domain. Molecular Basis of Peptide Recognition by Pdz," Cell 85(7):1067-1076, Cell Press, United States (1996).

Dufton, M.J., "Classification of Elapid Snake Neurotoxins and Cytotoxins According to Chain Length: Evolutionary Implications," Journal of Molecular Evolution 20(2):128-134, Springer-Verlag., Germany (1984).

Dumont, J.A., et al., "Prolonged Activity of a Recombinant Factor VIII-Fc Fusion Protein in Hemophilia A Mice and Dogs," Blood 119(13):3024-3030, The American Society of Hematology, United States (2012).

Dumoulin, M., et al., "Single-Domain Antibody Fragments with High Conformational Stability," Protein Science 11(3):500-515, Cold Spring Harbor Laboratory Press, United States (2002).

Dutton, J.L., et al., "A New Level of Conotoxin Diversity, A Non-Native Disulfide Bond Connectivity in Alpha-Conotoxin Auib Reduces Structural Definition But increases Biological Activity," The Journal of Biological Chemistry 277(50):48849-48857, American Society for Biochemistry and Molecular Biology, United States (2002).

Dyson, M.R., et al., "Production of Soluble Mammalian Proteins in *Escherichia coli*: Identification of Protein Features That Correlate With Successful Expression," BMC Biotechnology 4:32, American Society for Biochemistry and Molecular Biology, United States (2004).

Eaton, D.L., et al., "Construction and Characterization of an Active Factor VIII Variant Lacking the Central One-Third of the Molecule," Biochemistry 25(26):8343-8347, American Chemical Society, United States (1986).

Ellis, L.B and Milius, R.P., "Valid and invalid implementations of GOR secondary structure predictions," Computer Applications in Biosciences 10(3):341-348, Oxford University Press, United Kingdom (1994).

European Search Report and opinion for EP Application No. 08795371, dated Jan. 27, 2011.

European search report dated Feb. 4, 2010 for Application No. 6804210.

European search report dated Mar. 26, 2009 for Application No. 7752636.6.

European search report dated Mar. 5, 2009 for Application No. 7752549.1.

Fair, D.S. and Bahnak, B.R., et al., "Human hepatoma cells secrete single chain factor X, prothrombin, and antithrombin III," Blood 64(1):194-204, Grune & Stratton, Inc., United States (1984).

Fajloun, Z., et al., "Maurotoxin Versus Pi1/Hstx1 Scorpion Toxins," The Journal of Biological Chemistry 275(50):39394-39402, American Society for Biochemistry and Molecular Biology, United States (2000).

Felici, F., et al., "Selection of antibody ligands from a large library of oligopeptides expressed on a multivalent exposition vector," Journal of Molecular Biology 222(2):301-310, Elsevier Science, United States (1991).

Fisher, et al. "Genetic selection for protein solubility enabled by the folding quatliy control feature of the twin-arginin translocation pathway," Protein Science (2006) (online).

Fitzgerald, K. and Greenwald, I., "interchangeability of Caenorhabditis Elegans Dsl Proteins and intrinsic Signalling Activity of their Extracellular Domains in Vivo," Development 121(12):4275-4282, Company of Biologists Limited, England (1995).

Franz., T.J., "Percutaneous Absorption on the Relevance of in Vitro Data," Journal of Investigative Dermatology 64(3):190-195, Williams & Wilkins Co., United States (1975).

Frenal, et al.,, "Exploring Structural Features of the interaction Between the Scorpion Toxincnergl and Erg K+ Channels," Proteins 56(2):367-375, Wiley-Liss, United States (2004).

Freshney, R.I., "Quantitation and Experimental Design," in Culture of Animal Cells, pp. 227-296, Alan R. Liss, Inc., United States (1987).

Friend, P.J., et al., "Phase I Study of an Engineered Aglycosylated Humanized CD3 Antibody in Renal Transplant Rejection," Transplantation 68(11):1632-1637, Lippincott Williams & Wilkins, Inc., United States (1999).

Fulcher, C.A., et al., "Localization of human factor FVIII inhibitor epitopes to two polypeptide fragments," Proceedings of the National Academy of Sciences 82(22):7728-7732, National Academy of Sciences, United States (1985).

Gamez, et al., "Development of Pegylated forms of Recombinant Rhodosporidium Toruloides Phenylalanine Ammonia-Lyase for the Treatment of Classical Phenylketonuria," The Journal of the American Society of Gene Therapy 11(6):986-989, Academic Press, United States (2005).

Garnier, J., et al., "GOR method for predicting protein secondary structure from amino acid sequence," Methods in Enzymology 266:540-553, Academic Press, Inc., United States (1996).

Geething, N.C., et al., "Gcg-XTEN: an improved glucagon capable of preventing hypoglycemia without increasing baseline blood glucose," PLoS ONE 5(4):e10175, PLoS One, United States (Apr. 2010).

George, R.A. and Heringa, J., "An analysis of protein domain linkers: their classification and role in protein folding," Protein Engineering Design 15(11):871-879, Oxford University Press, England (2003).

Gilkes, N.R., et al., "Domains in Microbial Beta-1, 4-Glycanases: Sequence Conservation, Function, and Enzyme Families," Microbiological reviews 55(2):303-315, American Society for Microbiology, United States (1991).

Gilles, J.G., et al., "Anti-factor VIII antibodies of hemophiliac patients are frequently directed towards nonfunctional determinants and do not exhibit isotypic restriction," Blood 82(8):2452-2461, The American Society of Hematology, United States (1993).

Gitschier, J., et al., "Characterization of the Human Factor VIII Gene," Nature 312(5992):326-330, Nature Publishing Group, England (1984).

Gleeson, M.A., et al., "Transformation of the Methylotrophic Yeast *Hansenula polymorpha*," Journal of General Microbiology 132:3459-3465, Society for General Microbiology, England (1986).

(56) References Cited

OTHER PUBLICATIONS

Goeddel, D.V., et al., "Direct expression in *Escherichia coli* of a DNA sequence coding for human growth hormone," Nature 281(5732):544-548, MacMillan Journals Ltd., United States (1979).
Goeddel, D.V., et al., "Synthesis of human fibroblast interferon by *E. coli*," Nucleic Acids Research 8(18):4057-4074, IRL Press Limited, England (1980).
Gomez-Duarte., et al., "Expression of Fragment C of Tetanus Toxin Fused to a Carboxyl-Terminal Fragment of Diphtheria Toxin in *Salmonella typhi* Cvd 908 Vaccine Strain," Vaccine 13(16):1596-1602, Elsevier Science, Netherlands (1995).
Gouw, S.C., et al., "The multifactorial etiology of inhibitor development in hemophilia: genetics and environment," Seminars in Thrombosis and Hemostasis 35(8):723-734, Thieme Medical Publishers, Inc., United States (Nov. 2009).
Graff, C.P. and Wittrup, K.D., "Theoretical Analysis of Antibody Targeting of Tumor Spheroids: Importance of Dosage for Penetration, and Affinity for Retention," Cancer Research 63(6):1288-1296, American Association for Cancer Research, United States (2003).
Graham, F.L. and Smiley, J., "Characteristics of a Human Cell Line Transformed by DNA from Human Adenovirus Type 5," Journal of General Virology 36(1):59-72, Society for General Microbiology, England (1977).
Graham, F.L. and Van Der Eb, J., "A new technique for the assay of infectivity of human adenovirus 5 DNA," Virology 52(2):456-467, Academic Press, Inc., United States (1973).
Graw, J., et al., "Haemophilia A: From Mutation Analysis to New Therapies," Nature Reviews. Genetics 6(6):488-501, Nature Publishing Group, England (2005).
Gray, W.R., et al., "Peptide Toxins from Venomous Conus Snails," Annual Review of Biochemistry 57:665-700, Annual Reviews, United States (1988).
Greenwald, R.B., et al., "Effective Drug Delivery by PEGylated Drug Conjugates," Advanced Drug Delivery Reviews 55(2):217-250, Elsevier Science Publishers, B.V., Netherlands (2003).
Guncar, G., et al., "Crystal Structure of Mhc Class Ii-associated P41 Ii Fragment Bound to Cathepsin L Reveals the Structural Basis for Differentiation Between Cathepsins L and S," The EMBO Journal 18(4):793-803, Wiley Blackwell, England (1999).
Guo, M., et al., "Crystal Structure of the Cysteine-Rich Secretory Protein Stecrisp Reveals That the Cysteine-Rich Domain Has a K+ Channel inhibitor-Like Fold," The Journal of Biological Chemistry 280(13):12405-12412, American Society for Biochemistry and Molecular Biology, United States (2005).
Gupta, A., et al., "A Classification of Disulfide Patterns and Its Relationship to Protein Structure and Function," Protein Science : a Publication of the Protein Society 13(8):2045-2058, Cold Spring Harbor Laboratory Press, United States (2004).
Gustafsson, C., et al., "Codon Bias and Heterologous Protein Expression," Trends in Biotechnology 22(7):346-353, Elsevier Science Publishers, England (2004).
Hamers-Casterman, C., et al., "Naturally Occurring Antibodies Devoid of Light Chains," Nature 363(6428):446-448, Nature Publishing Group, England (1993).
Hammer, J., "New Methods to Predict Mhc-Binding Sequences Within Protein Antigens," Current Opinion in Immunology 7(2):263-269, Elsevier, England (1995).
Harlow, E. and Lane, D., "Cell Staining," Cold Spring Harbor Laboratory: 359-420 (1988).
Harris, J.L., et al., "Rapid and general profiling of protease specificity by using combinatorial fluorogenic substrate libraries," Proceedings of the National Academy of Sciences 97(14):7754-7759, National Academy of Sciences, United States (2000).
Harris, J.M. and Chess, R.B., "Effect of pegylation on pharmaceuticals," Nature Reviews Drug Discovery 2(3):214-221, Nature Publishing Group, England (2003).
Healey, J.F., et al., "The cDNA and Derived Amino Acid Sequence of Porcine Factor VIII" Blood 88(11):4209-4214, The American Society of Hematology, United States (1996).

Hedner, U. and Kisiel, W., "Use of human factor VIIa in the treatment of two hemophilia A patients with high-titer inhibitors," The Journal of Clinical Investigation 71(6):1836-1841, The American Society for Clinical Investigation, United States (1983).
Hedner, U., "NovoSeven® as a Universal Haemostatic Agent," Blood Coagulation & Fibrinolysis 11(Suppl 1):S107-S111, Lippincott Williams & Wilkins, England (2000).
Hennighausen, L.G. and Sippel, A.E., "Mouse Whey Acidic Protein is a Novel Member of the Family of 'Four-Disulfide Core' Proteins," Nucleic Acids Research 10(8):2677-2684, Oxford University Press, England (1982).
Hermeling, S., et al., "Structure-Immunogenicity Relationships of therapeutic Proteins," Pharmaceutical Research 21(6):897-903, Kluwer Academic/Plenum Publishers, United States (2004).
Higgins, J.A., et al., "Polyclonal and Clonal Analysis of Human Cd4+ T-Lymphocyte Responses to Nut Extracts," Immunology 84(1):91-97, Blackwell Scientific Publications, England (1995).
Higgins, J.M., et al., "Characterization of Mutant forms of Recombinant Human Properdin Lacking Single Thrombospondin Type I Repeats," Journal of Immunology 155(12):5777-5785, American Association of Immunologists, United States (1995).
Hill, J.M., et al., "Conotoxin TVIIA, A Novel Peptide from the Venom of Conus Tulipa 1," European Journal of Biochemistry / FEBS 267(15):4642-4648, Blackwell Science Ltd. on behalf of the Federation of European Biochemical Societies, England (2000).
Hinds, K.D., et al., "PEGylated insulin in PLGA microparticles. In vivo and in vitro analysis," Journal of Controlled Release 104(3):447-460, Elsevier B.V., Netherlands (2005).
Hirel, P.H., et al., "Extent of N-Terminal Methionine Excision from *Escherichia coli* Proteins is Governed by the Side-Chain Length of the Penultimate Amino Acid," Proceedings of the National Academy of Sciences of the United States of America 86(21):8247-8251, National Academy of Sciences, United States (1989).
Ho, S.N., et al., "Site-Directed Mutagenesis by Overlap Extension Using the Polymerase Chain Reaction," Gene 77(1):51-59, Elsevier Science Publishers B.V., Netherlands (1989).
Hoeben, R.C., et al., "Expression of Functional Factor VIII in Primary Human Skin Fibroblasts after Retrovirus-mediated Gene Transfer," The Journal of Biological Chemistry 265(13):7318-7323, The American Society for Biochemistry and Molecular Biology, United States (1990).
Hogg, P.J., "Disulfide Bonds as Switches for Protein Function," Trends in Biochemical Sciences 28(4):210-214, Elsevier Trends Journals, England (2003).
Holevinsky, K.O., et al., "Atp-Sensitive K+ Channel Opener Acts as a Potent C1-Channel inhibitor in Vascular Smooth Muscle Cells," The Journal of Membrane Biology 137(1):59-70, Springer., United States (1994).
Hopp, T.P. and Woods, K.R., "Prediction of protein antigenic determinants from amino acid sequences," Proceedings of the National Academy of Sciences 78(6):3824-3828, National Academy of Sciences, United States (1981).
Horton, R.M., et al., "Gene Splicing by Overlap Extension," Methods in Enzymology 217:270-279, Academic Press, United States (1993).
Hsu, C.T., et al., "Vaccination against gonadotropin-releasing hormone (GnRH) using toxin receptor-binding domain-conjugated GnRH repeats," Cancer Research 60(14):3701-3705, American Association for Cancer Research, United States (2000).
Hudson, P.J. and Kortt, A.A., "High Avidity Scfv Multimers; Diabodies and Triabodies," Journal of Immunological Methods 231(1-2):177-189, Elsevier, Netherlands (1999).
Hugli, T.E., "Structure and Function of C3A Anaphylatoxin," Current topics in Microbiology and Immunology 153:181-208, Springer Verlag, Germany (1990).
Huston, J.S., et al., "Protein Engineering of Antibody Binding Sites: Recovery of Specific Activity in an Anti-Digoxin Single-Chain Fv Analogue Produced in *Escherichia coli*," Proceedings of the National Academy of Sciences USA 85(16):5879-5883, National Academy of Sciences, United States (1988).
International Search Report and Written Opinion for Application No. PCT/US2011/043568, ISA/US, United States, dated Nov. 25, 2011, 10 pages.

(56) References Cited

OTHER PUBLICATIONS

International Search Report and Written Opinion for International Application No. PCT/US2010/002148, dated Dec. 1, 2010.
International Search Report and Written Opinion for International Application No. PCT/US2010/02147, dated Dec. 20, 2010.
International Search Report and Written Opinion for International Application No. PCT/US2010/061590, dated Jul. 12, 2011.
International Search Report and Written Opinion for International Application No. PCT/US2011/48517, ISA, United States, dated Mar. 14, 2012.
International search report dated Jan. 17, 2008 for PCT Application No. US2006/37713.
International search report dated Sep. 26, 2007 for PCT Application No. US2007/05857.
International Search Report for International Application No. PCT/US2007/05952, dated Dec. 26, 2007.
International Search Report for International Application No. PCT/US2008/09787, dated Mar. 16, 2009.
International Search Report for International Application No. PCT/US2010/23106, dated Apr. 20, 2010.
International Search Report for International Application No. PCT/US2010/37855, dated Oct. 29, 2010.
International Search Report for International Application No. PCT/US2012/46326, dated Jan. 25, 2013.
Israel, E.J., et al., "Expression of the neonatal Fc receptor, FcRn, on human intestinal epithelial cells," Immunology 92(1):69-74, Blackwell Sciences, England (1997).
Iwasaki, W., et al., "Solution Structure of Midkine, a New Heparin-Binding Growth Factor," The EMBO Journal 16(23):6936-6946, Wiley Blackwell, England (1997).
Jackson, J.K., et al., "The Characterization of Paclitaxel-Loaded Microspheres Manufactured from Blends of Poly(Lactic-Co-Glycolic Acid) (Plga) and Low Molecular Weight Diblock Copolymers," International Journal of Pharmaceutics 342(1-2):6-17, Elsevier/North-Holland Biomedical Press., Netherlands (2007).
Jacquemin, M., et al., "A human antibody directed to the factor VIII C1 domain inhibits factor VIII cofactor activity and binding to von Willebrand factor," Blood 95(1):156-163, The American Society of Hematology, United States (2000).
Johansson, J. and Hellman, L., "Modifications increasing the efficacy of recombinant vaccines; marked increase in antibody titers with moderately repetitive variants of a therapeutic allergy vaccine," Vaccine 25(9):1676-1682, Elsevier Ltd., United States (2007).
Jonassen, I., et, al., "Finding Flexible Patterns in Unaligned Protein Sequences", Protein Science 4(8):1587-1595, Cold Spring Harbor Laboratory Press, United States (1995).
Jones, M.D., et, al., "Determination of Tumor Necrosis Factor Binding Protein Disulfide Structure : Deviation of the Fourth Domain Structure from the Tnfr/Ngfr Family Cysteine-Rich Region Signature," Biochemistry 36(48):14914-14923, American Chemical Society., United States (1997).
Jones, P.T., et al., "Replacing the Complementarity-Determining Regions in a Human Antibody with those from a Mouse," Nature 321(6069):522-525, Nature Publishing Group, England (1986).
Jonsson, J., et, al., "Quantitative Sequence-Activity Models (Qsam) —Tools for Sequence Design", Nucleic Acids Research 21(3):733-739, Oxford University Press, England (1993).
Joosten, R.P., et al., "A series of PDB related databases for everyday needs," Nucleic Acids Research 39:D411-D419, Oxford University Press, England (2011).
Jung, S. and Honegger, A., "Improving In Vivo Folding and Stability of a Single-Chain Fv Antibody Fragment by Loop Grafting", Protein Engineering 10(8):959-966, Oxford University Press, England (1997).
Kabsch, W., "Dictionary of protein secondary structure: pattern recognition of hydrogen-bonded and geometrical features," Biopolymers 22(12):2577-2637, John Wiley & Sons, Inc., United States (1983).
Kamikubo, Y., et, al., "Disulfide Bonding Arrangements in Active forms of the Somatomedin B Domain of Human Vitronectin", Biochemistry 43(21):6519-6534, American Chemical Society., United States (2004).
Kasper, C.K., et al., "A More Uniform Measurement of Factor VIII Inhibitors," Thrombosis ET Diathesis Haemorhagica 34(1):612, F.K. Schattauer Verlag, New York (1975) (Abstract).
Kasuda, S., et al., "Establishment of embryonic stem cells secreting human factor VIII for cell-based treatment of hemophilia A," Journal of Thrombosis and Haemostasis 6(8):1352-1359, International Society on Thrombosis and Haemostasis, England (May 2008).
Kaufman, R.J. and Sharp, P.A., "Amplification and expression of sequences cotransfected with a modular dihydrofolate reductase complementary DNA gene," Journal of Molecular Biology 159(4):601-621, Academic Press, Inc. Ltd., England (1982).
Kaufman, R.J. and Sharp, P.A., "Construction of a modular dihydrofolate reductase cDNA gene: analysis of signals utilized for efficient expression," Molecular and Cellular Biology 2(11):1304-1319, American Society for Microbiology, United States (1982).
Kay, B.K., et, al., "An M13 Phage Library Displaying Random 38-Amino-Acid Peptides as a Source of Novel Sequences With Affinity to Selected Targets", Gene 128(1):59-65, Elsevier/North-Holland, Netherlands (1993).
Kazatchkine, M.D., et al., "Circulating immune complexes containing anti-VIII antibodies in multi-transfused patients with haemophilia A," American Journal of Clinical and Experimental Immunology 39(2):315-320, Blackwell Scientific Publications, United States (1980).
Kelly, K.A. and Jones, D.A., "isolation of a Colon Tumor Specific Binding Peptide Using Phage Display Selection", Neoplasia 5(5):437-444, BC Decker, Canada (2003).
Kemball-Cook, G., et al., "The factor VIII Structure and Mutation Resource Site: HAMSTeRS version 4," Nucleic Acids Research 26(1):216-219, Oxford University Press, England (1998).
Khan, R.H., et, al., "Solubilization of Recombinant Ovine Growth Hormone With Retention of Native-Like Secondary Structure and Its Refolding from the Inclusion Bodies of *Escherichia coli*", Biotechnology Progress 14(5):722-728, Wiley-Blackwell, United States (1998).
Kim, J.I., et al., "Three-Dimensional Solution Structure of the Calcium Channel Antagonist Omega-Agatoxin Iva: Consensus Molecular Folding of Calcium Channel Blockers," Journal of Molecular Biology 250(5):659-671, Elsevier, England (1995).
Kimble, J. and Simpson, P., "The Lin-12/Notch Signaling Pathway and Its Regulation," Annual Review of Cell and Developmental Biology 13:333-361, Annual Reviews, United States (1997).
Kisiel, W. and Fujikawa, K., "Enzymological aspects of blood coagulation," Behring Institute Mitteilungen 73:29-42, (1983).
Kissel, T., et al., "Aba-Triblock Copolymers from Biodegradable Polyester A-Blocks and Hydrophilic Poly (Ethylene Oxide ) B-Blocks as a Candidate for in Situ forming Hydrogel Delivery Systems for Proteins," Advanced Drug Delivery Reviews 54(1):99-134, Elsevier Science Publishers, Netherlands (2002).
Klitgaard, T. and Nielsen, T.G., "Overview of the human pharmacokinetics of recombinant activated factor VII," British Journal of Clinical Pharmacology 65(1):3-11, Blackwell Publishing Ltd., England (2007).
Kobayashi, N., et al., "FcRn-Mediated Transcytosis of Immunoglobulin G in Human Renal Proximal Tubular Epithelial Cells," American Journal of Physiology 282(2):F358-F365, American Physiological Society, United States (2002).
Kochendoerfer, G., "Chemical and biological properties of polymer-modified proteins," Expert Opinion on Biological Therapy 3(8):1253-1261, Ashley Publications Ltd., England (2003).
Kohn, J.E., et al., "Random-coil behavior and the dimensions of chemically unfolded proteins," Proc Natl Acad Sci USA 101(34):12491-14296, National Academy of Sciences, United States (2004).
Koide, A., et al., "The Fibronectin type III Domain as a Scaffold for
Koide, A., et al., The Fibronectin type III Domain as a Scaffold for Novel Binding Proteins," Journal of Molecular Biology 284(4):1141-1151, Academic Press, United States (1998).
Konig, T. and Skerra, A., "Use of an Albumin-Binding Domain for the Selective Immobilisation of Recombinant Capture Antibody

(56) References Cited

OTHER PUBLICATIONS

Fragments on ELISA Plates," Journal of Immunological Methods 218(1-2):73-83, Elsevier Science B.V., Netherlands (1998).

Kornblatt, J.A. and Lake, D.F., "Cross-linking of cytochrome oxidase subunits with difluorodinitrobenzene," Canadian Journal of Biochemistry 58(3):219-224, National Research Council of Canada, Canada (1980).

Kortt, A.A., et al., "Single-Chain Fv Fragments of Anti-Neuraminidase Antibody Nc10 Containing Five- and Ten-Residue Linkers form Dimers and with Zero-Residue Linker A Trimer ," Protein Engineering 10(4):423-433, Oxford University Press, England (1997).

Kou, G., et al., "Preparation and Characterization of Recombinant Protein Scfv(Cd11C)-Trp2 for Tumor therapy from inclusion Bodies in *Escherichia coli*," Protein Expression and Purification 52(1):131-138, Academic Press, United States (2007).

Kratzner, R., et, al., "Structure of Ecballium Elaterium Trypsin Inhibitor Ii (Eeti-Ii ): A Rigid Molecular Scaffold", Acta Crystallographica 61(Pt 9):1255-1262, Wiley-Blackwell, United States (2005).

Kristensen, P. and Winier, G., "Proteolytic Selection for Protein Folding Using Filamentous Bacteriophages," Folding & Design 3(5):321-328, Current Biology, England (1998).

Kubetzko, S., et al., "Protein PEGylation decreases observed target association rates via a dual blocking mechanism," Molecular Pharmacology 68(5):1439-1454, The American Society for Pharmacology and Experimental Therapeutics, United States (2005).

Kurachi, K. and Davie, E.W., "Isolation and characterization of a cDNA coding for human factor IX," Proceedings of the National Academy of Sciences 79(21):6461-6464, National Academy of Sciences, United States (1982).

Kwon, Y.M. and Kim, S.W., "Biodegradable Triblock Copolymer Microspheres Based on thermosensitive Sol-Gel Transition," Pharmaceutical Research 21(2):339-343, Kluwer Academic/Plenum Publishers, United States (2004).

Kyngas, J. and Valjakka, J., "Unreliability of the Chou-Fasman parameters in predicting protein secondary structure," Protein Engineering 11(5):345-348, Oxford University Press, England (1998).

Lane, M.E., et, al., "Influence of Post-Emulsification Drying Processes on the Microencapsulation of Human Serum Albumin", International Journal of Pharmaceutics 307(1):16-22, Amsterdam, Elsevier/North-Holland Biomedical Press., Netherlands (2006).

Langner, K-D., et al., "Synthesis of Biologically Active Deletion Mutants of Human Factor VIII:C," Behring Institute Mitteilungen 82:16-25, Behringwerke AG, Germany (1988).

Lapatto, R. et al., The EMBO Journal 16(17):5151-5161, Wiley Blackwell England (1997)., "X-ray structure of antistatin at 1.9 A resolution and its modelled complex with blood coagulation factor Xa".

Larrick, J.W., et al., "Rapid Cloning of Rearranged Immunoglobulin Genes from Human Hybridoma Cells using Mixed Primers and the Polymerase Chain Reaction," Biochemical and Biophysical Research Communications 160(3):1250-1256, Academic Press, United States (1989).

Lauber, T., et al., "Homologous Proteins With Different Folds: the Three-Dimensional Structures of Domains 1 and 6 of the Multiple Kazal-Type inhibitor Lekti," Journal of Molecular Biology 328(1):205-219, Elsevier, England (2003).

Lavigne-Lissalde, G., et al., "Characteristics, mechanisms of action, and epitope mapping of anti-factor VIII antibodies," Clinical Reviews in Allergy & Immunology 37(2):67-79, Humana Press, United States (Oct. 2009).

Le Gall, F., et al., "Di-, Tri- and Tetrameric Single Chain Fv Antibody Fragments Against Human Cd19: Effect of Valency on Cell Binding," FEBS Letters 453(1-2):164-168, Elsevier Science B.V, Netherlands (1999).

Lee, A.Y., et al., "A recombinant human G-CSF/GM-CSF fusion protein from *E. coli* showing colony stimulating activity on human bone marrow cells," Biotechnology Letters 25(3):205-211, Kluwer Academic Publishers, Netherlands (2003).

Lee V.H., "Mucosal Drug Delivery," Journal of the National Cancer Institute Monographs 29:41-44, Oxford University Press, United States (2001).

Lenting, P.J., et al., "Clearance mechanisms of von Willebrand factor and factor VIII," Journal of Thrombosis and Haemostasis 5(7):1353-1360, International Society on Thrombosis and Haemostasis, England (2007).

Lenting, P.J., et al., "The Life Cycle of Coagulation Factor VIII in View of its Structure and Function," Blood 92(11):3983-3996, American Society of Hematology, United States (1998).

Lenting, P.J., et al., "The light chain of factor VIII comprises a binding site for low density lipoprotein receptor-related protein," The Journal of Biological Chemistry 274(34):23734-23739, The American Society for Biochemistry and Molecular Biology, Inc., United States (1999).

Leong, S.R., et, al., "Adapting Pharmacokinetic Properties of a Humanized Anti-Interleukin-8 Antibody for therapeutic Applications Using Site-Specific Pegylation", Cytokine 16(3):106-119, Elsevier Science Ltd., England (2001).

Leong, S.R., et, al., "Optimized Expression and Specific Activity of Il-12 by Directed Molecular Evolution", Proceedings of the National Academy of Sciences of the United States of America 100(3):1163-1168, National Academy of Sciences, United States (2003).

Lethagen, S., et al., "Clinical application of the chromogenic assay of factor VIII in haemophilia A, and different variants of von Willebrand's disease," Scandinavian Journal of Haematology 37(5):448-453, Munksgaard and International Publishers Ltd, United States (1986).

Leung, et al., "A method for random mutagenesis of a defined DNA segment using a modified polymerase chain reaction" Technique 1: 11-15, (1989).

Leung-Hagesteijn, C., et al., "Unc-5, A Transmembrane Protein With Immunoglobulin and Thrombospondin Type 1 Domains, Guides Cell and Pioneer Axon Migrations in C," Cell 71(2):289-299, Cell Press, United States (1992).

Levitt, M., "A simplified representation of protein conformations for rapid simulation of protein folding," Journal of Molecular Biology 104(1):59-107, Elsevier Ltd., United States (1976).

Levy, R., et al., "Isolation of Trans-Acting Genes That Enhance Soluble Expression of Scfv Antibodies in the E," Journal of Immunological Methods 321(1-2):164-173, Elsevier, Netherlands (2007).

Leyte, A., et al., "The interaction between human blood-coagulation factor VIII and von Willebrand factor:Characterization of a high-affinity binding site on Factor VIII," Biochemical Journal 257(3):679-683, Biochemical Society, England (1989).

Leyte, A.,et al., "Sulfation of Tyr1680 of human blood coagulation factor VIII is essential for the interaction of factor VIII with von Willebrand factor," The Journal of Biological Chemistry 266(2):740-746, The American Society for Biochemistry and Molecular Biology,Inc., United States (1991).

Lillicrap, D., "Extending Half-life in Coagulation Factors: Where do We Stand?," Thrombosis Research, 122(Suppl 4):S2-S8, Pergamon Press, United States (Oct. 2008).

Lin, C.C. and Metters, A.T., "Metal-Chelating Affinity Hydrogels for Sustained Protein Release", Journal of Biomedical Materials Research Part A 83(4):954-964, John Wiley & Sons, United States (2007).

Lirazan, M.B., et, al., "The Spasmodic Peptide Defines a New Conotoxin Superfamily", Biochemistry 39(7):1583-1588, Washington, American Chemical Society., United States (2000).

Liu, L., et, al., "The Human Beta-Defensin-1 and Alpha-Defensins are Encoded by Adjacent Genes: Two Peptide Families With Differing Disulfide Topology Share a Common Ancestry", Genomics 43(3):316-320, Academic Press, United States (1997).

Liu, T., et al., "Evaluation of PEG-FVIII Molecules with Prolonged Half-lives in a Murine FVIII-Dependent Bleeding Model," Journal of Thrombosis and Haemostasis 9(Suppl. 2): P-M-035, ISTH Meeting, Poster: Factor VIII, Factor V, Exhibition Area, International Society on Thrombosis and Haemostasis, United States (2007), Abstract only.

Liu, T., et al., "Recombinant FVIII Fc fusion protein is fully active in treating acute injury and demonstrates prolonged prophylactic efficacy in hemophilia a mice," Journal of Thrombosis and Haemostasis

(56) References Cited

OTHER PUBLICATIONS

9(Suppl. 2): P-WE-131, ISTH Meeting, International Society on Thrombosis and Haemostasis, United States (2011).

Logan, J., et al., "Adenovirus Tripartite Leader Sequence Enhances Translation of mRNAs Late After Infection," Proceedings of the National Academy of Sciences USA 81(12):3655-3659, National Academy of Sciences, United States (1984).

Lollar, P., et al., "Inhibition of human factor VIIIa by anti-A2 subunit antibodies," The Journal of Clinical Investigation 93(6):2497-2504, The American Society for Biochemistry and Molecular Biology,Inc., United States (1994).

London, F.S. and Walsh, P.N., "Zymogen factor IX potentiates factor IXa-catalyzed factor X activation," Biochemistry 39(32):9850-9858, American Chemical Society, United States (2000).

Lowman, H.B., et, al., "Selecting High-Affinity Binding Proteins by Monovalent Phage Display", Biochemistry 30(45):10832-10838, Washington, American Chemical Society., United States (1991).

Loyter, A., et al., "Mechanisms of DNA uptake by mammalian cells: fate of exogenously added DNA monitored by the use of fluorescent dyes," Proceedings of the National Academy of Sciences 79(2):422-426, National Academy of Sciences, United States (1982).

Mackett, M., et al., "General Method for Production and Selection of Infectious Vaccinia Virus Recombinants Expressing Foreign Genes," Journal of Virology 49(3):857-864, American Society for Microbiology, United States (1984).

Mackett, M., et al., "Vaccinia Virus: A Selectable Eukaryotic Cloning and Expression Vector," Proceedings of the National Academy of Sciences USA 79(23):7415-7419, National Academy of Sciences, United States (1982).

Maggio, "A Renaissance in Peptide Therapeutics in Underway" Drug Delivery Reports 23-26, (2006).

Maggio, E.T., "Intravail: Highly Effective Intranasal Delivery of Peptide and Protein Drugs", Expert Opinion on Drug Delivery 3(4):529-539, Inform Healthcare, England (2006).

Maillere, B., et, al., "Immunogenicity of a Disulphide-Containing Neurotoxin : Presentation to T-Cells Requires a Reduction Step", Toxicon 33(4):475-482, Pergamon Press, England (1995).

Maillere, B., et, al., "Role of Thiols in the Presentation of a Snake Toxin to Murine T Cells", Journal of Immunology 150(12):5270-5280, American Association of Immunologists, United States (1993).

Malardier, L., et al., "Cloning of the nitrate reductase gene (niaD) of Aspergillus nidulans and its use for transformation of Fusarium oxysporum," Gene 78(1):147-156, Elsevier Science Publishers B.V., Netherlands (1989).

Marshall, C.B., et, al., "Enhancing the Activity of a Beta-Helical Antifreeze Protein by the Engineered Addition of Coils", Biochemistry 43(37):11637-11646, Washington, American Chemical Society., United States (2004).

Martin, L., et al., "Rational Design of a Cd4 Mimic That inhibits Hiv-1 Entry and Exposes Cryptic Neutralization Epitopes," Nature Biotechnology 21(1):71-76, Nature America Publishing, United States (2003).

Martin, P.G., et al., "Evaluation of a novel ELISA screening test for detection of factor VIII inhibitory antibodies in haemophiliacs," Clinical & Laboratory Haematology 21(2):125-128, Blackwell Publishing, England (1999).

Martineau, P., et, al., "Expression of an Antibody Fragment at High Levels in the Bacterial Cytoplasm", Journal of Molecular Biology 280(1):117-127, Elsevier, England (1998).

Matthews, D.J. and Wells, J.A., "Substrate phage: selection of protease substrates by monovalent phage display," Science 260(5111):1113-1117, American Association for the Advancement of Science, United States (1993).

McCue, J.T., et al., "Application of a Novel Affinity Adsorbent for the Capture and Purification of Recombinant Factor VIII Compounds," Journal of Chromatography A 1216(45):7824-7830, Elsevier, Netherlands (Nov. 6, 2009).

McDonald, D.M. and Baluk, P., "Significance of Blood Vessel Leakiness in Cancer," Cancer research 62(18):5381-5385, American Association for Cancer Research, United States (2002).

McKnight, G.L., et al., "Identification and molecular analysis of a third Aspergillus nidulans alcohol dehydrogenase gene," The EMBO Journal 4(8):2093-2099, IRL Press Limited, England (1985).

McNulty, J.C., et, al., "High-Resolution Nmr Structure of the Chemically-Synthesized Melanocortin Receptor Binding Domain Agrp (87-132 ) of the Agouti-Related Protein", Biochemistry 40(51):15520-15527, American Chemical Society., United States (2001).

Zhu, S., et al., "Molecular Cloning and Sequencing of Two 'Short Chain' and Two 'Long Chain' K(+) Channel-blocking Peptides from the Chinese Scorpion Buthus Martensii Karsch," FEBS Letters 457(3):509-514, Elsevier Science, Netherlands (1999).

Meeks, S.L., et al., "Antihuman factor VIII C2 domain antibodies in hemophilia A mice recognize a functionally complex continuous spectrum of epitopes dominated by inhibitors of factor VIII activation," Blood 110(13):4234-4242, The American Society of Hematology, United States (2007).

Meeks, S.L., et al., "Non-classical anti-factor VIII C2 domain antibodies are pathogenic in a murine in vivo bleeding model," Journal of Thrombosis and Haemostasis 7(4):658-664, International Society on Thrombosis and Haemostasis, England (Apr. 2009).

Mei, B., et al., "Expression of Human Coagulation Factor VIII in a Human Hybrid Cell Line, HKB11," Molecular Biotechnology 34(2):165-178, Humana Press Inc., United States (2006).

Meier, S., et, al., "Determination of a High-Precision Nmr Structure of the Minicollagen Cysteine Rich Domain from Hydra and Characterization of Its Disulfide Bond formation", FEBS Letters 569(1-3):112-116, Elsevier Science B.V, Netherlands (2004).

International Search Report for International Patent Application No. PCT/US2015/010738, United States Patent Office, Alexandria, Virginia, dated May 15, 2015.

Meulien, P., et al., "A new Recombinant Procoagulant Protein Derived from the cDNA Encoding Human Factor VIII," Protein Engineering 2(4):301-306, IRL Press Ltd., England (1988).

Miao, H.Z., et al., "Bioengineering of coagulation factor VIII for improved secretion," Blood 103(9):3412-3419, The American Society of Hematology, United States (2004).

Miljanich, G.P., "Ziconotide: Neuronal Calcium Channel Blocker for Treating Severe Chronic Pain", Current Medicinal Chemistry 11(23):3029-3040, Bentham Science Publishers, Netherlands (2004).

Misenheimer, T.M. and Mosher, D.F., "Biophysical Characterization of the Signature Domains of Thrombospondin-4 and Thrombospondin-2", The Journal of Biological Chemistry 280(50):41229-41235, American Society for Biochemistry and Molecular Biology, United States (2005).

Misenheimer, T.M., et, al., "Disulfide Connectivity of Recombinant C-Terminal Region of Human Thrombospondin 2", The Journal of Biological Chemistry 276(49):45882-45887, American Society for Biochemistry and Molecular Biology, United States (2001).

Mitraki, A. and Jonathan, K.,, "Protein Folding Intermediates and Inclusion Body Formation," Nature Biotechnology 7:690-697, Nature Publishing Group, England (1989).

Mogk, A., et, al., "Mechanisms of Protein Folding: Molecular Chaperones and their Application in Biotechnology", a European journal of Chemical Biology 3(9):807-814, Wiley-VCH Verlag, Germany (2002).

Morfini, M. "Secondary prophylaxis with factor IX concentrates: continuous infusion," Blood Transfusion 6(Suppl 2):S21-S25, Italy (Sep. 2008).

Morpurgo, M., et al., "Covalent modification of mushroom tyrosinase with different amphiphic polymers for pharmaceutical and biocatalysis applications," Applied Biochemistry and Biotechnology 56(1):59-72, Humana Press, Inc., United States (1996).

Mount, J.D., et al., "Sustained Phenotypic Correction of Hemophilia B dogs with a Factor IX Null Mutation by Liver-Directed Gene Therapy," Blood 99(8):2670-2676, The American Society of Hematology, United States (2002).

Mrsny, R.J., et al., "Bacterial Toxins as Tools for Mucosal Vaccination," Drug Discovery Today 7(4):247-258, Elsevier Science Ltd., England (2002).

Murtuza, B., et, al., "Transplantation of Skeletal Myoblasts Secreting an Il-1 Inhibitor Modulates Adverse Remodeling in Infarcted Murine Myocardium", Proceedings of the National Academy of

(56) References Cited

OTHER PUBLICATIONS

Sciences of the United States of America 101(12):4216-4221, National Academy of Sciences, United States (2004).

Narita, M., et al., "The Low-Density Lipoprotein Receptor-Related Protein (LRP) Mediates Clearance of Coagulation Factor Xa In Vivo," Blood 91(2):555-560, The American Society of Hematology, United States (1998).

Narmoneva, D.A., et, al., "Self-Assembling Short Oligopeptides and the Promotion of Angiogenesis," Biomaterials 26(23):4837-4846, Elsevier Science, NethQerlands (2005).

Needleman, S.B. and Wunsch, C.D., "A General Method Applicable to the Search for Similarities in the Amino Acid Sequence of Two Proteins," Journal of Molecular Biology 48(3):443-453, Academic Press, England (1970).

Neumann, E., et al., "Gene Transfer into Mouse Lyoma Cells by Electroporation in High Electric Fields," The EMBO Journal 1(7):841-845, IRL Press Limited, England (1982).

Ngo, J.C., et al., "Crystal structure of human factor VIII: implications for the formation of the factor IXa-factor VIIIa complex," Structure 16(4):597-606, Elsevier Ltd., United States (Apr. 2008).

Nielsen, C.U. and Brodin, B., "Di/Tri-Peptide Transporters as Drug Delivery Targets: Regulation of Transport Under Physiological and Patho-Physiological Conditions", Current Drug Targets 4(5):373-388, Bentham Science Publishers, Netherlands (2003).

Nielsen, K.J., et, al., "Solution Structure of Mu-Conotoxin Piiia, A Preferential Inhibitor of Persistent Tetrodotoxin-Sensitive Sodium Channels", The Journal of biological chemistry 277(30):27247-27255, American Society for Biochemistry and Molecular Biology, United States (2002).

Noe, D.A., "A mathematical model of coagulation factor VIII kinetics," Haemostasis 26(6):289-303, S. Karger AG, Basel, Germany (1996).

Nord, K., et al., "Binding Proteins Selected from Combinatorial Libraries of an Alpha-Helical Bacterial Receptor Domain," Nature Biotechnology 15(8):772-777, Nature America Publishing, United States (1997).

O'Brien, D.P., et al., "Purification and Characterization of Factor VIII 372-Cys: A Hypofunctional Cofactor From a Patient With Moderately Severe Hemophilia A," Blood 75(8):1664-1672, American Society of Hematology, United States (1990).

O'Connell, D., et, al., "Phage Versus Phagemid Libraries for Generation of Human Monoclonal Antibodies", Journal of Molecular Biology 321(1):49-56, Elsevier, England (2002).

Office Action dated Apr. 16, 2013, in U.S. Appl. No. 12/806,005, Schellenberger, et al., filed Aug. 2, 2010.

Office Action dated Aug. 23, 2012, in U.S. Appl. No. 12/848,984, Schellenberger, et al., filed Aug. 2, 2010.

Office Action dated Feb. 25, 2014, in U.S. Appl. No. 13/392,509, Schellenberger, et al., filed Feb. 24, 2012.

Office Action dated Jan. 14, 2014, in U.S. Appl. No. 12/796,650, Schellenberger, et al., filed Jun. 8, 2010.

Office Action dated Jul. 2, 2013 in U.S. Appl. No. 13/392,511, Schellenberger, V. et al., filed Jun. 27, 2012.

Office Action dated Jun. 21, 2013, in U.S. Appl. No. 12/806,004, Schellenberger, et al., filed Aug. 2, 2010.

Office Action dated Mar. 22, 2013, in U.S. Appl. No. 12/796,650, Schellenberger, et al., filed Jun. 8, 2010.

Office Action dated May 7, 2013, in U.S. Appl. No. 12/699,761, Schellenberger, et al., filed Feb. 3, 2010.

Office Action dated May 20, 2014 in U.S. Appl. No. 13/392,511, Schellenberger, V. et al., filed Jun. 27, 2012.

Office Action dated Oct. 5, 2012, in U.S. Appl. No. 12/806,004, Schellenberger, et al., filed Aug. 2, 2010.

Office Action dated Oct. 20, 2014 in U.S. Appl. No. 13/392,511, Schellenberger, V. et al., filed Jun. 27, 2012.

Office Action dated Sep. 11, 2013, in U.S. Appl. No. 12/848,984, Schellenberger, et al., filed Aug. 2, 2010.

Ofir, K., et, al., "Versatile Protein Microarray Based on Carbohydrate-Binding Modules", Proteomics 5(7):1806-1814, Wiley-VCH, Germany (2005).

Okten, Z., et, al., "Myosin Vi Walks Hand-Over-Hand Along Actin", Nature structural molecular biology 11(9):884-887, Nature Pub. Group, United States (2004).

O'Leary, JM., et, al., "Solution Structure and Dynamics of a Prototypical Chordin-Like Cysteine-Rich Repeat (Von Willebrand Factor Type C Module) from Collagen Iia", The Journal of Biological Chemistry 279(51):53857-53866, American Society for Biochemistry and Molecular Biology, United States (2004).

Zhuo, R., et al., "Procoagulant stimulus processing by the intrinsic pathway of blood plasma coagulation," Biomaterials 26(16):2965-2973, Elsevier Ltd., United States (2005).

Osterud, B., et al., "Activation of the coagulation factor VII by tissue thromboplastin and calcium," Biochemistry 11(15):2853-2857, American Chemical Society, United States (1972).

Padiolleau-Lefevre, S., et, al., "Expression and Detection Strategies for an Scfv Fragment Retaining the Same High Affinity Than Fab and Whole Antibody: Implications for therapeutic Use in Prion Diseases", Molecular immunology 44(8):1888-1896, Pergamon Press, England (2007).

Pallaghy, P.K., et, al., "A Common Structural Motif Incorporating a Cystine Knot and a Triple-Stranded Beta-Sheet in Toxic and Inhibitory Polypeptides", Protein Science 3(10):1833-1839, Cold Spring Harbor Laboratory Press, United States (1994).

Pallaghy, P.K., et, al., "Three-Dimensional Structure in Solution of the Calcium Channel Blocker Omega-Conotoxin", Journal of Molecular Biology 234(2):405-420, Elsevier, England (1993).

Palmiter, R.D., et al., "Metallothionein-human GH fusion genes stimulate growth of mice," Science 222(4625):809-814, American Association for the Advancement of Science, United States (1983).

Pan, T.C., et, al., "Structure and Expression of Fibulin-2, A Novel Extracellular Matrix Protein With Multiple Egf-Like Repeats and Consensus Motifs for Calcium Binding", The Journal of Cell Biology 123(5):1269-1277, Rockefeller University Press, United States (1993).

Panda, A.K., "Bioprocessing of therapeutic Proteins from the Inclusion Bodies of *Escherichia coli*", Advances in Biochemical Engineering/Biotechnology 85:43-93, Springer Verlag, Germany (2003).

Panicali, D., et al., "Construction of Poxviruses as Cloning Vectors: Insertion of the Thymidine Kinase Gene from Herpes Simplex Virus into the DNA of Infectious Vaccinia Virus," Proceedings of the National Academy of Sciences of the United States of America 79(16):4927-4931, The National Academy of Sciences of the United States (1982).

Park, C.H., et al., "A diagnostic challenge: mild hemophilia B with normal activated partial thromboplastin time," Blood Coagulation and Fibrinolysis 21(4):368-371, Lippincott Williams & Wilkins, England (Jun. 2010).

Patra, A.K., et, al., "Optimization of Inclusion Body Solubilization and Renaturation of Recombinant Human Growth Hormone from *Escherichia coli*", Protein Expression and Purification 18(2):182-192, Academic Press, United States (2000).

Pelegrini, P.B. and Franco, O.L., "Plant Gamma-Thionins: Novel Insights on the Mechanism of Action of a Multi-Functional Class of Defense Proteins", The International Journal of Biochemistry Cell Biology 37(11):2239-2253, Elsevier, Netherlands (2005).

Pepinsky, R.B., et al., "Improved pharmacokinetic properties of a polyethylene glycol-modified form of interferon-β-1a with preserved in vitro bioactivity," The Journal of Pharmacology and Experimental Therapeutics 297(3):1059-1066, The American Society for Pharmacology and Experimental Therapeutics, United States (2001).

Petersen, SV., et, al., "The Dual Nature of Human Extracellular Superoxide Dismutase: One Sequence and Two Structures", Proceedings of the National Academy of Sciences of the United States of America 100(24):13875-13880, National Academy of Sciences, United States (2003).

Pi, C., et al., "Analysis of Expressed Sequence Tags from the Venom Ducts of Conus Striatus: Focusing on the Expression Profile of Conotoxins," Biochimie 88(2):131-140, Editions Scientifiques Elsevier, France (2006).

Pimanda, J.E.. et. al., "The Von Willebrand Factor-Reducing Activity of Thrombospondin-1 is Located in the Calcium-Binding/C-

(56) References Cited

OTHER PUBLICATIONS

Terminal Sequence and Requires a Free Thiol at Position 974", Blood 100(8):2832-2838, American Society of Hematology, United States (2002).
Pipe, S.W., et al., "Functional factor VIII made with von Willebrand factor at high levels in transgenic milk," Journal of Thrombosis and Haemostasis 9(11):2235-2242, International Society on Thrombosis and Haemostasis, England (Nov. 2011).
Pipe, S.W., et al., "Functional roles of the factor VIII B domain," Haemophilia 15(6):1187-1196, Blackwell Publishing Ltd., England (Nov. 2009).
Pipe, S.W. "The promise and challenges of bioengineered recombinant clotting factors," Journal of Thrombosis and Haemostasis 3(8):1692-1701, International Society on Thrombosis and Haemostasis, United States (2005).
Pokidysheva, E., et, al., "The Structure of the Cys-Rich Terminal Domain of Hydra Minicollagen, Which is Involved in Disulfide Networks of the Nematocyst Wall", The Journal of Biological Chemistry 279(29):30395-30401, American Society for Biochemistry and Molecular Biology, United States (2004).
Popkov, M., et al., "Isolation of Human Prostate Cancer Cell Reactive Antibodies Using Phage Display Technology", Journal of Immunological Methods 291(1-2):137-151, Elsevier, Netherlands (2004).
Prilusky, J., et al., "FoldIndex: a simple tool to predict whether a given protein sequence is intrinsically unfolded," Bioinformatics 21(16):3435-43438, Oxford University Press, England (2005).
Prinz, W.A., et al., "The Role of the Thioredoxin and Glutaredoxin Pathways in Reducing Protein Disulfide Bonds in the *Escherichia coli* Cytoplasm," The Journal of Biological Chemistry 272(25):15661-15667, American Society for Biochemistry and Molecular Biology, United States (1997).
Qi, R.F., et al., "Structural Features and Molecular Evolution of Bowman-Birk Protease inhibitors and their Potential Application," Acta biochimica et biophysica Sinica 37(5):283-292, American Society for Biochemistry and Molecular Biology, United States (2005).
Rao, L.V.M., et al., "Activation of human factor VII during clotting in vitro," Blood 65(1):218-226, Grune & Stratton, Inc., United States (1985).
Rao, M.B., et al., "Molecular and Biotechnological aspects of Microbial Proteases," Microbiology and Molecular Biology Reviews : MMBR 62(3):597-635, American Society for Microbiology, United States (1998).
Rasmussen, U.B., et al., "Tumor Cell-Targeting by Phage-Displayed Peptides," Cancer gene therapy 9(7):606-612, Nature Publishing Group, England (2002).
Rawlings, N.D., et al., "Evolutionary Families of Peptidase inhibitors," The Biochemical Journal 378(Pt 3):705-716, Published by Portland Press on behalf of the Biochemical Society, England (2004).
Rawlings, N.D., et al., "MEROPS: the peptidase database," Nucleic Acids Research 36:D320-D325, Oxford University Press, England (Nov. 2007).
Rebay, I., et al., "Specific EGF Repeats of Notch Mediate Interactions with Delta and Serrate: Implications for Notch as a Multifunctional Receptor," Cell 67(4):687-699, Cell Press, United States (1991).
Roberge, M., et al., "Construction and Optimization of a Cc49-Based Scfv-Beta-Lactamase Fusion Protein for Adept," Protein engineering, design & selection : PEDS 19(4):141-145, Oxford University Press, England (2006).
Rosa, G.D., et al., "Influence of the Co-Encapsulation of Different Non-Ionic Surfactants on the Properties of Plga insulin-Loaded Microspheres," Journal of Controlled Release 69(2):283-295, Elsevier Science Publishers, Netherlands (2000).
Rosenfeld, R.D., et al., "Biochemical, Biophysical, and Pharmacological Characterization of Bacterially Expressed Human Agouti-Related Protein," Biochemistry 37(46):16041-16052, Washington, American Chemical Society., United States (1998).

Rosen, S., "Assay of Factor VIII:C with a Chromogenic Substrate," New Frontiers in Hemophilia Research, the XVth World Federation of Hemophilia Congress, Stockholm, Sweden, Jun. 27-Jul. 1, 1983, published in Scandinavian Journal of Rheumatology Supplement 33(540):139-145, Munksgaard, Denmark (1984).
Roth, J. et al., "From Microbes to Man" in Polysialic Acid, Roth J., Rutishauser U., Troy F.A., eds., pp. 335-348, BirkhauserVerlag, Basel, Switzerland (1993).
Roussel, A., et al., "Complexation of Two Proteic insect inhibitors to the Active Site of Chymotrypsin Suggests Decoupled Roles for Binding and Selectivity," The Journal of biological chemistry 276(42):38893-38898, American Society for Biochemistry and Molecular Biology, United States (2001).
Routledge, E.G., et al., "The Effect of Aglycosylation on the Immunogenicity of a Humanized Therapeutic CD3 Monoclonal Antibody," Transplantation 60(8):847-853, Williams & Wilkins, United States (1995).
Ruberti, F., et al., "The Use of the RACE Method to Clone Hybridoma cDNA When V Region Primers Fail," Journal of Immunological Methods 173(1):33-39, Elsevier, United States (1994).
Ruther, U. and Muller-Hill, B., "Easy Identification of cDNA Clones," EMBO J 2(10):1791-1794, IRL Press Ltd, England (1983).
Rychkov, G. and Petukhov, M., "Joint neighbors approximation of macromolecular solvent accessible surface area," Journal of Computational Chemistry 28(12):1974-1989, Wiley Periodicals, Inc., United States (2007).
Saenko, E.L., et al., "Role of the low density lipoprotein-related protein receptor in mediation of factor VIII catabolism," The Journal of Biological Chemistry 274(53):37685-37692, The American Society for Biochemistry and Molecular Biology, Inc., United States (1999).
Saenko, E.L., et al., "The future of recombinant coagulation factors," Journal of Thrombosis and Haemostasis 1:922-930, International Society on Thrombosis and Haemostasis, England (2005).
Saenko, E.L. and Pipe, S.W., "Strategies Towards a Longer Acting Factor VIII," Haemophilia 12 (Suppl 3):42-51, Blackwell Publishing Ltd, England (2006).
Sahdev, S., et al., "Production of Active Eukaryotic Proteins Through Bacterial Expression Systems: A Review of the Existing Biotechnology Strategies," Molecular and Cellular Biochemistry 307(1-2):249-264, Kluwer Academic, Netherlands (Jan. 2008).
Salloum, F.N., et al., "Anakinra in Experimental Acute Myocardial Infarction—Does Dosage or Duration of Treatment Matter?," Cardiovascular drugs and therapy sponsored by the International Society of Cardiovascular Pharmacotherapy 23(2):129-135, Kluwer Academic for the International Society for Cardiovascular Pharmacotherapy, United States (Apr. 2009).
GenBank: EIW63862.1. hypothetical protein TRAVEDRAFT_138159 (Trametes versicolor FP-101664 SS1]. Available at http://www.ncbi.nlm.nih.gov/protein/392570690?report=genbank&log$=protalign&blast_rank=1&RID=3ERS0M7501R. Accessed on Jun. 11, 2015, 3 pages.
NCBI Reference Sequence: WP_005158338.1. Serine phosphatase RsbU, regulator of sigma subunit [Amycolatopsis azure]]. Available at http://www.ncbi.nlm.nih.gov/protein/491300334?report=genbank&log$=protalign&blast_rank=1&RID=3ERS0M7501R. Accessed on Jun. 11, 2015, 2 pages.
Sarver, N., et al., "Stable Expression of Recombinant Factor VIII Molecules Using a Bovine Papillomavirus Vector," DNA 6(6):553-564, Mary Ann Liebert, Inc., United States (1987).
Scandella, D., et al., "Epitope mapping of human factor VIII inhibitor antibodies by deletion analysis of factor VIII fragments expressed in *Escherichia coli*," Proceedings of the National Academy of Sciences 85(16):6152-6156, National Academy of Sciences, United States (1988).
Scandella, D., et al., "Localization of epitopes for human factor VIII inhibitor antibodies by immunoblotting and antibody neutralization," Blood 74(5):1618-1626, Grune & Stratton, Inc., United States (1989).
Schellenberger, V., et al., "A Recombinant Polypeptide Extends the in Vivo Half-Life of Peptides and Proteins in a Tunable Manner," Nature Biotechnology 27(12):1186-1190, Nature America, Inc., United States (Dec. 2009).

(56) References Cited

OTHER PUBLICATIONS

Schellenberger, V., et al., "Analysis of enzyme specificity by multiple substrate kinetics," Biochemistry 32(16):4344-4348, The American Chemical Society, United States (1993).
Schlapschy, M., et al., "Fusion of a recombinant antibody fragment with a homo-amino-acid polymer: effects on biophysical properties and prolonged plasma half-life," Protein Engineering Design & Selection 20(6):273-284, Oxford University Press, England (2007).
Schmidt, A.E. and Bajaj, S.P., "Structure-function relationships in factor IX and factor IXa," Trends in Cardiovascular Medicine 13(1):39-45, Elsevier Science, United States (2003).
Scholle, M.D., et, al., "Efficient Construction of a Large Collection of Phage-Displayed Combinatorial Peptide Libraries", Combinatorial Chemistry High Throughput Screening 8(6):545-551, Bentham Science Publishers, Netherlands (2005).
Schulte, S., et al., "Prolonged in-vivo half-life of factor VIIa by fusion to albumin," Blood (ASH Annual Meeting) 110:Abstract 3142, American Society of Hematology, United States (2007).
Schulte, S., "Use of Albumin Fusion Technology to Prolong the Half-Life of Recombinant Factor VIIa," Thrombosis Research 122(Suppl 4):S14-S19, Elsevier Ltd., United States (Dec. 2008).
Schultz-Cherry, S., et, al., "Regulation of Transforming Growth Factor-Beta Activation by Discrete Sequences of Thrombospondin 1", The Journal of Biological Chemistry 270(13):7304-7310, American Society for Biochemistry and Molecular Biology, United States (1995).
Schultz-Cherry, S., et, al., "The Type 1 Repeats of Thrombospondin 1 Activate Latent Transforming Growth Factor-Beta", The Journal of Biological Chemistry 269(43):26783-26788, American Society for Biochemistry and Molecular Biology, United States (1994).
Schulz, H., et, al., "Potential of Nir-Ft-Raman Spectroscopy in Natural Carotenoid Analysis", Biopolymers 77(4):212-221, Wiley Interscience, United States (2005).
NCBI Reference Sequence: XP_003746909.1. PREDICTED: electron transfer flavoprotein subunit alpha, mitochondrial-like [Metaseiulus occidentalis]. Available at http://www.ncbi.nlm.nih.gov/protein/391345263?report=genbank&log$=protalign&blast_rank=1&RID=3ERS0M7501R. Accessed on Jun. 11, 2015, 3 pages.
Sheffield, W.P., et al., "Effects of genetic fusion of factor IX to albumin on in vivo clearance in mice and rabbits," British Journal of Haematology 126(4):565-573, Blackwell Publishing Ltd., England (2004).
Shen, B.W., et al., "The tertiary structure and domain organization of coagulation factor VIII," Blood 111(3):1240-1247, The American Society of Hematology, United States (Feb. 2008).
Shen, Z. and Jacobs-Lorena, M., "A Type I Peritrophic Matrix Protein from the Malaria Vector Anopheles Gambiae Binds to Chitin Cloning, Expression, and Characterization", The Journal of Biological Chemistry 273(28):17665-17670, American Society for Biochemistry and Molecular Biology, United States (1998).
Shields, R.L., et al., "High Resolution Mapping of the Binding Site on Human IgG1 for FcγRI, FcβRII, FcγRIII, and FcRn and Design of IgG1 Variants with Improved Binding to the FcγR," The Journal of Biological Chemistry 276(9):6591-6604, The American Society for Biochemistry and Molecular Biology, Inc., United States (2001).
Shima, M., et al., "A factor VIII neutralizing monoclonal antibody and a human inhibitor alloantibody recognizing epitopes in the C2 domain inhibit factor VIII binding to von Willebrand factor and to phosphatidylserine," Journal of Thrombosis and Haemostasis 69(3):240-246, Schattauer GmbH, Germany (1993).
Sidhu, S.S., et, al., "Phage Display for Selection of Novel Binding Peptides", Methods in Enzymology 328:333-363, New York, Academic Press., United States (2000).
Silverman, J., et, al., "Multivalent Avimer Proteins Evolved by Exon Shuffling of a Family of Human Receptor Domains", Nature Biotechnology 23(12):1556-1561, Nature America Publishing, United States (2005).
Simonet, G., et al., "Structural and Functional Properties of a Novel Serine Protease inhibiting Peptide Family in Arthropods," Comparative Biochemistry and Physiology. Part B, Biochemistry & molecular biology 132(1):247-255, Pergamon, England (2002).
Simonsen, C.C., et al., "Isolation and Expression of an Altered Mouse Dihydrofolate Reductase cDNA," Proceedings of the National Academy of Sciences 80(9):2495-2499, National Academy of Sciences, United States (1983).
Singh, H. and Raghava, G.P.S., "ProPred: Prediction of HLA-DR binding sites," Bioinformatics 17(12):1236-1237, Oxford University Press, England (2001).
Skinner, W.S., et, al., "Purification and Characterization of Two Classes of Neurotoxins from the Funnel Web Spider, Agelenopsis Aperta", The Journal of Biological Chemistry 264(4):2150-2155, American Society for Biochemistry and Molecular Biology, United States (1989).
Smith, D.B. and Johnson, K.S., "Single-step purification of polypeptides expressed in Escherichia coli as fusions with glutathione S-transferase," Gene 67(1):31-40, Elsevier Science B.V., Netherlands (1988).
Smith, G.E., et al., "Molecular Engineering of the Autographa californica Nuclear Polyhedrosis Virus Genome: Deletion Mutations Within the Polyhedrin Gene," Journal of Virology 46(2):584-593, American Society for Microbiology, United States (1983).
Smith, G.P. and Petrenko, V.A., "Phage Display," Chemical Reviews 97(2):391-410, American Chemical Society, United States (1997).
Smith, T.F. and Waterman, M.S., "Comparison of Biosequences," Advances in Applied Mathematics 2(4):482-489, Academic Press, Inc., United States (1981).
So, T., et, al., "Contribution of Conformational Stability of Hen Lysozyme to Induction of Type 2 T-Helper Immune Responses," Immunology 104(3):259-268, Blackwell Scientific Publications, England (2001).
Sommermeyer, V.K., et al., "Klinisch Verwendete Hydroxyethylstarke: Physikalisch-Chemische Charakterisierung," Krankenhauspharmazie 8(8):271-278, Deutscher Apotheker Verlag, Birkenwaldstr, Germany (1987).
Southern, P.J. and Berg, P., "Transformation of mammalian cells to antibiotic resistance with a bacterial gene under control of the SV40 early region promoter," Journal of Molecular and Applied Genetics 1(4):327-341, Raven Press, United States (1982).
Srivastava, R. and McShane, M.J., "Application of Self-Assembled Ultra-Thin Film Coatings to Stabilize Macromolecule Encapsulation in Alginate Microspheres", Journal of Microencapsulation 22(4):397-411, Informa Healthcare, England (2005).
Stamos, J., et, al., "Crystal Structure of the Hgf Beta-Chain in Complex With the Sema Domain of The Met Receptor", The EMBO Journal 23(12):2325-2335, Wiley Blackwell, England (2004).
Steipe, B., et, al., "Sequence Statistics Reliably Predict Stabilizing Mutations in a Protein Domain," Journal of Molecular Biology 240(3):188-192, Elsevier, England (1994).
Stemmer, W.P., et, al., "Single-Step Assembly of a Gene and Entire Plasmid from Large Numbers of Oligodeoxyribonucleotides" Gene 164(1):49-53, Amsterdam, Elsevier/North-Holland, Netherlands (1995).
Stemmer, W.P., "Rapid Evolution of a Protein In Vitro by DNA Shuffling ," Nature 370(6488):389-391, Nature Publishing Group, England (1994).
Stickler, M., et al., "Human population-based identification of CD4+ T-cell peptide epitope determinants," Journal of Immunological Methods 281(1-2):95-108, Elsevier B.V., Netherlands (2003).
Stites, W.E. and Pranata, J., "Empirical Evaluation of the Influence of Side Chains on the Conformational Entropy of the Polypeptide Backbone," Proteins: Structure, Function and Genetics 22(2):132-140, Wiley-Liss, Inc., United States (1995).
Stoll, B.R., et al., "A Mechanistic Analysis of Carrier-Mediated Oral Delivery of Protein therapeutics," Journal of controlled release 64(1-3):217-228, Elsevier Science Publishers, Netherlands (2000).
Story, C.M., et al., "A Major Histocompatibility Complex Class I-like Fc Receptor Cloned from Human Placenta: Possible Role in Transfer of Immunoglobulin G from Mother to Fetus," The Journal of Experimental Medicine 180(6):2377-2381, The Rockefeller University Press, United States (1994).
Sturniolo, T., et al., "Generation of tissue-specific and promiscuous HLA ligand databases using DNA microarrays and virtual HLA

(56) References Cited

OTHER PUBLICATIONS class II matrices," Nature Biotechnology 17(6):555-561, Nature America Inc., United States (1999).
Subramani, S., et al., "Expression of the mouse dihydrofolate reductase complementary deoxyribonucleic acid in simian virus 40 vectors," Molecular and Cellular Biology 1(9):854-864, American Society for Microbiology, United States (1981).
Suetake, T., et, al., "Chitin-Binding Proteins in Invertebrates and Plants Comprise a Common Chitin-Binding Structural Motif", The Journal of Biological Chemistry 275(24):17929-17932, American Society for Biochemistry and Molecular Biology, United States (2000).
Suetake, T., et, al., "Production and Characterization of Recombinant Tachycitin, the Cys-Rich Chitin-Binding Protein", Protein Engineering 15(9):763-769, Oxford University Press, England (2002).
Summers, M.D. and Smith, G.E., "Baculovirus structural polypeptides," Virology 84(2):390-402, Academic Press, Inc., United States (1978).
Takahashi, H., et al., "Solution Structure of Hanatoxinl, A Gating Modifier of Voltage-Dependent K(+) Channels: Common Surface Features of Gating Modifier Toxins," Journal of Molecular Biology 297(3):771-780, Elsevier, England (2000).
Takenobu, T., et, al., "Development of P53 Protein Transduction therapy Using Membrane-Permeable Peptides and the Application to Oral Cancer Cells", Molecular Cancer Therapeutics 1(12):1043-1049, American Association for Cancer Research, Inc., United States (2002).
Tam, J.P. and Lu, Y.A., "A Biomimetic Strategy in the Synthesis and Fragmentation of Cyclic Protein", Protein science 7(7):1583-1592, Cold Spring Harbor Laboratory Press, United States (1998).
Tavladoraki, P., et al., "A Single-Chain Antibody Fragment is Functionally Expressed in the Cytoplasm of Both *Escherichia coli* and Transgenic Plants," European Journal of Biochemistry / FEBS 262(2):617-624, Blackwell Science Ltd. on behalf of the Federation of European Biochemical Societies, England (1999).
Tax, F.E., et al., "Sequence of C. elegans lag-2 reveals a cell-signalling domain shared with Delta and Serrate of *Drosophila*," Nature 368(6467):150-154, The National Academy of Sciences, United States (1994).
Terpe, K., "Overview of Tag Protein Fusions: from Molecular and Biochemical Fundamentals to Commercial Systems", Applied Microbiology and Biotechnology 60(5):523-533, Springer International, Germany (2003).
Thai, R., et, al., "Antigen Stability Controls Antigen Presentation", The Journal of Biological Chemistry 279(48):50257-50266, American Society for Biochemistry and Molecular Biology, United States (2004).
Thomas, P.S., "Hybridization of denatured RNA and small DNA fragments transferred to nitrocellulose," Proceedings of the National Academy of Sciences 77(9):5201-5205, National Academy of Sciences, United States (1980).
Tolkatchev, D., et, al., "Design and Solution Structure of a Well-Folded Stack of Two Beta-Hairpins Based on the Amino-Terminal Fragment of Human Granulin A," Biochemistry 39(11):2878-2886, Washington, American Chemical Society., United States (2000).
Toole, J.J., et al., "A large region (95 kDa) of human factor VIII is dispensable for in vitro procoagulant activity," Proceedings of the National Academy of Sciences USA 83(16):5939-5942, National Academy of Sciences, United States (1986).
Toole, J.J., et al., "Molecular Cloning of a cDNA Encoding Human Antihaemophilic Factor," Nature 312(5992):342-347, Nature Publishing Group, England (1984).
Torres, A.M., et, al., "Solution Structure of a Defensin-Like Peptide from Platypus Venom", The Biochemical Journal 341( Pt 3):785-794, Published by Portland Press on behalf of the Biochemical Society, England (1999).
Towfighi, F., et al., "Comparative measurement of anti-factor VIII antibody by Bethesda assay and ELISA reveals restricted isotype profile and epitope specificity," Acta Haematol 114(2):84-90, S. Karger AG, Basel, Germany(2005).

Tuddenham, E.G.D., et al., "Response to infusions of polyelectrolyte fractionated human factor VIII concentrate in human haemophilia A and von Willebrand's disease," British Journal of Haematology 52(2):259-267, Wiley-Blackwell, England (1982).
Tur, M.K., et, al., "A Novel Approach for Immunization, Screening and Characterization of Selected Scfv Libraries Using Membrane Fractions of Tumor Cells", International Journal of Molecular Medicine 11(4):523-527, D.A. Spandidos, Greece (2003).
UniProtKB/Swiss-Prot, "ELNE_HUMAN," accession No. P08246, accessed at http://www.uniprot.org/uniprot/P08246, accessed on Dec. 16, 2014, 19 pages.
UniProtKB/Swiss-Prot, "FA10_HUMAN," accession No. P00742, accessed at http://www.uniprot.org/uniprot/P00742, accessed on Dec. 16, 2014, 25 pages.
UniProtKB/Swiss-Prot, "FA11_HUMAN," accession No. P03951, accessed at http://www.uniprot.org/uniprot/P03951, accessed on Dec. 16, 2014, 22 pages.
UniProtKB/Swiss-Prot, "FA12_HUMAN," accession No. P00748, accessed at http://www.uniprot.org/uniprot/P00748, accessed on Dec. 16, 2014, 14 pages.
UniProtKB/Swiss-Prot, "FA7_HUMAN," accession No. P08709, accessed at http://www.uniprot.org/uniprot/P08709, accessed on Dec. 16, 2014, 27 pages.
UniProtKB/Swiss-Prot, "FA9_HUMAN," accession No. P00734, accessed at http://www.uniprot.org/uniprot/P00740, accessed on Dec. 16, 2014, 26 pages.
UniProtKB/Swiss-Prot, "KLKB1_HUMAN," accession No. P03952, accessed at http://www.uniprot.org/uniprot/P03952, accessed on Dec. 16, 2014, 11 pages.
UniProtKB/Swiss-Prot, "MMP12_HUMAN," accession No. P39900, accessed at http://www.uniprot.org/uniprot/P39900, accessed on Dec. 16, 2014, 12 pages.
UniProtKB/Swiss-Prot, "MMP13_HUMAN," accession No. P45452, accessed at http://www.uniprot.org/uniprot/P45452, accessed on Dec. 16, 2014, 15 pages.
UniProtKB/Swiss-Prot, "MMP17_HUMAN," accession No. Q9ULZ9, accessed at http://www.uniprot.org/uniprot/Q9ULZ9, accessed on Dec. 16, 2014, 11 pages.
UniProtKB/Swiss-Prot, "MMP20_HUMAN," accession No. O60882, accessed at http://www.uniprot.org/uniprot/O60882, accessed on Dec. 16, 2014, 10 pages.
UniProtKB/Swiss-Prot, "THRB_HUMAN," accession No. P00734, accessed at http://www.uniprot.org/uniprot/P00734, accessed on Dec. 16, 2014, 42 pages.
Urlaub, G. and Chasin, L.A., "Isolation of Chinese hamster cell mutants deficient in dihydrofolate reductase activity," Proceedings of the National Academy of Sciences 77(7):4216-4220, National Academy of Sciences, United States (1980).
Uversky, V.N., et al., "Why are "natively unfolded" proteins unstructured under physiologic conditions?," Proteins: Structure, Function and Genetics 41(3):415-427, Wiley-Liss, Inc., United States (2000).
Valente, C.A., et, al., "Optimization of the Primary Recovery of Human Interferon Alpha2B from *Escherichia coli* Inclusion Bodies", Protein Expression and Purification 45(1):226-234, Academic Press, United States (2006).
Van Den Hooven H.W., et, al., "Disulfide Bond Structure of the Avr9 Elicitor of the Fungal Tomato Pathogen Cladosporium Fulvum : Evidence for a Cystine Knot", Biochemistry 40(12):3458-3466, Washington, American Chemical Society., United States (2001).
Van Vlijmen, H.W., et, al., "A Novel Database of Disulfide Patterns and Its Application to the Discovery of Distantly Related Homologs", Journal of Molecular Biology 335(4):1083-1092, Elsevier, England (2004).
Vanhercke, T., et, al., "Reducing Mutational Bias in Random Protein Libraries", Analytical Biochemistry 339(1): 9-14, Academic Press, United States (2005).
Vardar, D., et al., "Nuclear Magnetic Resonance Structure of a Prototype Lin12-Notch Repeat Module from Human Notchl," Biochemistry 42(23):7061-7067, American Chemical Society, United States (2003).
Vehar, G.A., et al., "Structure of Human Factor VIII," Nature 312(5992):337-342, Nature Publishing Group, England (1984).

(56) References Cited

OTHER PUBLICATIONS

Venkatachalam, C.M. and Ramachandran, G.N., "Conformation of polypeptide chains," Annual Review of Biochemistry 38:45-82, Annual Reviews, United States (1969).

Venkateswarlu, D., "Structural investigation of zymogenic and activated forms of human blood coagulation factor VIII: a computational molecular dynamics study," BMC Structural Biology 10:7, BioMed Central, England (Feb. 2010).

Ventura, S., "Sequence Determinants of Protein Aggregation: Tools to Increase Protein Solubility", Microbial Cell Factories 4(1):11, Academic Press, United States (2005).

Verbruggen, B., et al., "Improvements in factor VIII inhibitor detection: From Bethesda to Nijmegen," Seminars in Thrombosis and Hemostasis 35(8):752-759, Thieme Medical Publishers, Inc., United States (Nov. 2009).

Verbruggen, B., et al., "The Nijmegen modification of the Bethesda assay for factor VIII:C inhibitors: improved specificity and reliability," Journal of Thrombosis and Haemostasis 73(2):247-251, Schattauer GmbH, Germany (1995).

Vestergaard-Bogind, B., et, al., "Single-File Diffusion Through the Ca2+-Activated K+ Channel of Human Red Cells", The Journal of Membrane Biology 88(1):67-75, New York, Springer., United States (1985).

Voisey, J. and Van, Daal, A., "Agouti: from Mouse to Man, from Skin to Fat", Pigment cell research sponsored by the European Society for Pigment Cell Research and the International Pigment Cell Society 15(1):10-18, Munksgaard International Publishers, Denmark (2002).

Vorobjev, P.E., et al., "Oligonucleotide Conjugated to Linear and Branched High Molecular Weight Polyethylene Glycol as Substrates for RNase H," Nucleosides & Nucleotides 18(11-12):2745-2750, Marcel Dekker, Inc., United States (1999).

Vranken, W.F., et al., "A 30-Residue Fragment of the Carp Granulin-1 Protein Folds into a Stack of Two Beta-Hairpins Similar to That Found in the Native Protein," The Journal of Peptide Research : official journal of the American Peptide Society 53(5):590-597, Munksgaard, Denmark (1999).

Wagenvoord, R.J., et al., "Development of a Simple Chromogenic Factor VIII Assay for Clinical Use," Haemostasis 19(4):196-204, Karger Publishers, Switzerland (1989).

Walker, J.R., et al., "Using protein-based motifs to stabilize peptides," The Journal of Peptide Research 62(5):214-226, Blackwell Munksgaard, Denmark (2003).

Wang., "Parenteral Formulations of Proteins and Peptides: Stability and Stabilizers," Journal of Parenteral Science and Technology 42:2S, Parenteral Drug Association, Bethesda (1988).

Wang, X., et, al., "Structure-Function Studies of Omega-Atracotoxin, A Potent Antagonist of Insect Voltage-Gated Calcium Channels", European journal of biochemistry / FEBS 264(2):488-494, Blackwell Science Ltd. on behalf of the Federation of European Biochemical Societies, England (1999).

Ward, E.S. and Ghetie, V., "The Effector Functions of Immunoglobulins: Implications for Therapy," Therapeutic Immunology 2(2):77-94, Blackwell Science Ltd., England (1995).

Ward, E.S., et al., "Binding Activities of a Repertoire of Single Immunoglobulin Variable Domains Secreted from *Escherichia coli*," Nature 331:544-546, Nature Publishing Group, England (1989).

Watters, J.M., et, al., "An Optimized Method for Cell-Based Phage Display Panning", Immunotechnology 3(1):21-29, Elsevier, Netherlands (1997).

Weidler, B., et al., "Pharmakokinetische Merkmale als Kriterien fur den klinischen Einsatz von Hydroxyethylstarke," Arzneimittel-Forschung 41(5):494-498, Editio Cantor, Germany (1991).

Weimer, T., et al., "Prolonged in-vivo half-life of factor VIIa by fusion to albumin," Thrombosis and Haemostasis 99(4):659-667, Schattauer GmbH, Germany (Apr. 2008).

Weiss, H.J., et al., "Stabilization of factor VIII in plasma by the von Willebrand factor. Studies on posttransfusion and dissociated factor VIII and in patients with von Willebrand's disease," The Journal of Clinical Investigation 60(2):390-404, The American Society for Biochemistry and Molecular Biology,Inc., United States (1977).

Weiss, M.S., et, al., "A Cooperative Model for Receptor Recognition and Cell Adhesion : Evidence from the Molecular Packing in the 16-A Crystal Structure of the Pheromone Er-1 from the Ciliated Protozoan Euplotes Raikovi", Proceedings of the National Academy of Sciences of the United States of America 92(22):10172-10176, National Academy of Sciences, United States (1995).

Wentzel, A., et, al., "Sequence Requirements of the Gpng Beta-Turn of the Ecballium Elaterium Trypsin Inhibitor Ii Explored by Combinatorial Library Screening", The Journal of Biological Chemistry 274(30):21037-21043, American Society for Biochemistry and Molecular Biology, United States (1999).

Werle, M., et, al., "The Potential of Cystine-Knot Microproteins as Novel Pharmacophoric Scaffolds in Oral Peptide Drug Delivery", Journal of Drug Targeting 14(3):137-146, Informa Healthcare, England (2006).

Werther, W.A., et al., "Humanization of an Anti-Lymphocyte Function-associated Antigen (Lfa)-1 Monoclonal Antibody and Reengineering of the Humanized Antibody for Binding to Rhesus Lfa-1," Journal of Immunology 157(11):4986-4995, American Association of Immunologists, United States (1996).

White, G.C., II. and Shoemaker, C.B., "Factor VIII Gene and Hemophilia A," Blood 73(1):1-12, Grune & Stratton, Inc., United States (1989).

Whitlow, M., et, al., "Multivalent Fvs: Characterization of Single-Chain Fv Oligomers and Preparation of a Bispecific Fv", Protein Engineering 7(8):1017-1026, Oxford University Press, England (1994).

Wigler, M., et al., "Biochemical Transfer of Single-Copy Eucaryotic Genes Using Total Cellular DNA as Donor," Cell 14(3):725-731, Cell Press, United States (1978).

Winter, G. and Harris, W.J., "Humanized Antibodies", Trends in pharmacological sciences 14(5):139-143, Published by Elsevier in Association With the International Union of Pharmacology, England (1993).

Wittrup, K.D., "Protein Engineering by Cell-Surface Display", Current Opinion in Biotechnology 12(4):395-399, Elsevier, England (2001).

Wood, W.I., et al., "Expression of Active Human Factor VIII from Recombinant DNA Clones," Nature 312(5992):330-337, Nature Publishing Group, England (1984).

Worn, A. and Pluckthun, A., "Stability Engineering of Antibody Single-Chain Fv Fragments ," Journal of Molecular Biology 305(5):989-1010, Elsevier, England (2001).

Worn, A., et, al., "Correlation Between In Vitro Stability and In Vivo Performance of Anti-Gcn4 Intrabodies as Cytoplasmic Inhibitors", The Journal of Biological Chemistry 275(4):2795-2803, American Society for Biochemistry and Molecular Biology, United States (2000).

Wrammert, J., et, al., "Rapid Cloning of High-Affinity Human Monoclonal Antibodies Against Influenza Virus," Nature 453(7195):667-671, Nature Publishing Group, England (May 2008).

Wright, P.E. and Dyson, H.J., "Intrinsically unstructured proteins: re-assessing the protein structure-function paradigm," Journal of Molecular Biology 293(2):321-331, Academic Press, England (1999).

Xiong, J.P., et, al., "A Novel Adaptation of the Integrin Psi Domain Revealed from Its Crystal Structure", The Journal of Biological Chemistry 279(39):40252-40254, American Society for Biochemistry and Molecular Biology, United States (2004).

Xu, Y., et, al., "Solution Structure of Bmp02 , A New Potassium Channel Blocker from the Venom of the Chinese Scorpion *Buthus martensi karsch*", Biochemistry 39(45):13669-13675, American Chemical Society., United States (2000).

Yamazaki, T., et, al., "A Possible Physiological Function and the Tertiary Structure of a 4-Kda Peptide in Legumes", European Journal of Biochemistry / FEBS 270(6):1269-1276, Blackwell Science Ltd. on behalf of the Federation of European Biochemical Societies, England (2003).

Yang, C.Y., et al., "Intestinal Peptide Transport Systems and Oral Drug Availability," Pharmaceutical Research 16(9):1331-1343, Kluwer Academic/Plenum Publishers, United States (1999).

(56) References Cited

OTHER PUBLICATIONS

Yang, K., et al., "Tailoring structure-function and pharmacokinetic properties of single-chain Fv proteins by site-specific PEGylation," Protein Engineering 16(10):761-770, Oxford University Press, England (2003).

Yang, W.P., et al., "Cdr Walking Mutagenesis for the Affinity Maturation of a Potent Human Anti-Hiv-1 Antibody into the Picomolar Range," Journal of Molecular Biology 254(3):392-403, Elsevier, England (1995).

Yang, Z.R., et al., "RONN: the bio-basis function neural network technique applied to the detection of natively disordered regions in proteins," Bioinformatics 21(16):3369-3376, Oxford University Press, England (2005).

Yankai, Z., et al., "Ten tandem repeats of β-hCG 109-118 enhance immunogenicity and anti-tumor effects of β-hCG C-terminal peptide carried by mycobacterial heat-shock protein HSP65," Biochemical and Biophysical Research Communications 345(4):1365-1371, Elsevier Inc., United States (2006).

Yuan, X., et, al., "Solution Structure of the Transforming Growth Factor Beta-Binding Protein-Like Module, A Domain Associated With Matrix Fibrils", The EMBO Journal 16(22):6659-6666, Wiley Blackwell, England (1997).

International Search Report for International Patent Application No. PCT/US2013/021330, United States Patent Office, Alexandria, Virginia, dated Apr. 29, 2013.

International Search Report for International Patent Application No. PCT/US2013/026521, United States Patent Office, Alexandria, Virginia, dated Apr. 24, 2013.

International Search Report for International Patent Application No. PCT/US2013/049989, United States Patent Office, Alexandria, Virginia, dated Dec. 16, 2013.

International Search Report for International Patent Application No. PCT/US2014/044731, United States Patent Office, Alexandria, Virginia, dated Nov. 4, 2014.

International Search Report for International Patent Application No. PCT/US2014/051144, United States Patent Office, Alexandria, Virginia, dated Feb. 10, 2015.

International Search Report for International Patent Application No. PCT/US2014/040370, United States Patent Office, Alexandria, Virginia, dated Jan. 9, 2015.

Co-pending U.S. Appl. No. 14/379,196, inventor Kulman, J., filed Aug. 15, 2014 (Not Published).

Co-pending U.S. Appl. No. 14/521,397, inventors Stemmer, W., et al., filed Oct. 22, 2014 (Not Published).

Bai, Y., et al., "Recombinant granulocyte colony-stimulating factor-transferrin fusion protein as an oral myelopoietic agent," Proceedings of the National Academy of Sciences USA 102(20):7292-7296, National Academy of Sciences, United States (2005).

Bovenschen, N., et al., "LDL Receptor Cooperates with LDL Receptor-Related Protein in Regulating Plasma Levels of Coagulation Factor VIII in Vivo," Blood 106(3):906-912, The American Society of Hematology, United States (2005).

Bovenschen, N., "LDL Receptor Polymorphisms Revisited," Blood 116(25):5439-5440, The American Society of Hematology, United States (Dec. 2010).

Brandsma, M.E., et al., "Recombinant human transferrin: Beyond iron binding and transport," Biotechnology Advances 29(2):230-238, Elsevier, United States (2011).

Co-pending U.S. Appl. No. 14/466,567, inventors Schellenberger, et al., filed Aug. 22, 2014 (Not Published).

Office Action dated Jun. 17, 2015, in U.S. Appl. No. 14/317,888, Schellenberger, et al., filed Jun. 27, 2014.

Davidson, M.W., "Engineered fluorescent proteins: innovations and applications," Nature Methods 6(10):713-717, Nature Publishing Group, England (2009).

Fang, H., et al., "The protein structure and effect of factor VIII," Thrombosis Research 119(1):1-13, Elsevier, United States (2007).

Fares, F.A., "Design of a long-acting follitropin agonist by fusing the C-terminal sequence of the chorionic gonadotropin beta subunit to the follitropin beta subunit," Proceedings of the National Academy of Sciences 89(10):4304-4308, The National Academy of Sciences of the United States (1992).

Fraczkiewicz, R., et al., "Exact and Efficient Analytical Calculation of the Accessible Surface Areas and Their Gradients for Macromolecules," Journal of Computational Chemistry 19:319-333, John Wiley & Sons, United States (1998).

Francis, G.E., "Protein Modification and Fusion Proteins," Focus on Growth Factors 3(2):4-10, Mediscript, England (1992).

GenBank, "*Homo sapiens* coagulation factor VIII, procoagulant component (F8), transcript variant 1, mRNA," Accession No. NM_000132.3, accessed at http://www.ncbi.nlm.nih.gov/nuccore/NM_000132.3, accessed on May 11, 2014, 12 pages.

GenBank, "*Homo sapiens* Transferrin (TF), mRNA," Accession No. NM001063.3 published on May 25, 2014, accessed at http://www.ncbi.nlm.nih.gov/nuccore/NM_001063, accessed on Sep. 24, 2014, 5 pages.

GenBank, "*Homo sapiens* Transferrin (TF), mRNA," Accession No. XM002793 published on May 13, 2002, accessed at https://www.ncbi.nlm.nih.gov/nuccore/XM_002793.7?report=genbank, accessed on Sep. 24, 2014, 2 pages.

GenBank, "*Homo sapiens* Transferrin (TF), mRNA," Accession No. XM039845 published Jul. 16, 2001, accessed at https://www.ncbi.nlm.nih.gov/nuccore/XM_039845.1?report=genbank, accessed on Sep. 24, 2015, 2 pages.

GenBank, "*Homo sapiens* Transferrin (TF), mRNA," Accession No. XM039847 published on Jul. 16, 2001, accessed at http://www.ncbi.nlm.nih.gov/nuccore/XM_039847.1?report=genbank, accessed on Sep. 24, 2015, 2 pages.

GenBank, "Human Transferrin mRNA, Complete cds," Accession No. M12530.1, published on Jan. 14, 1995, accessed at http://www.ncbi.nlm.nih.gov/nuccore/M1253014, accessed on Jan. 15, 2015, 2 pages.

GenBank, "Transferrin [human, liver, mRNA, 2347 nt]," Accession No. S95936.1, published on May 7, 1993, accessed at http://www.ncbi.nlm.nih.gov/nuccore/S95936, accessed on Sep. 24, 2014, 2 pages.

Kim, B.J., et al., "Transferrin Fusion Technology: a Novel Approach to Prolonging Biological Half-Life of Insulinotropic Peptides," The Journal of Pharmacology and Experimental Therapeutics 334(3):682-692, American Society for Pharmacology and Experimental Therapeutics, United States (Sep. 2010).

Kraulis, P.J., et al., "The Serum Albumin-Binding Domain of Streptococcal Protein G is a Three-Helical Bundle: a Heteronuclear NMR study," FEBS Letters 378(2):190-194, Elsevier Science B.V,Netherlands (1996).

Kulman, J.D., et al., "A versatile system for site-specific enzymatic biotinylation and regulated expression of proteins in cultured mammalian cells," Protein Expression and Purification 52(2):320-328, Elsevier, United States (2007).

Lee, C.A., et al., "Pharmacokinetics of Recombinant Factor VIII (Recombinate) Using One-Stage Clotting and Chromogenic Factor VIII Assay," Thrombosis and Haemostasis 82(6):1644-1647, Schattauer Verlag, Germany (1999).

Lenting, P.J., et al., "Biochemistry of FVIII and Inhibitors: The Disappearing Act of Factor VIII," Haemophilia 16(102):6-15, Blackwell Publishing Ltd, England (May 2010).

Li, H., et al., "The role of the transferrin-transferrin-receptor system in drug delivery and targeting," Trends in Pharmacological Sciences 23(5):206-209, Elsevier Science Ltd., England (2002).

Linhult, M., et al., "Mutational Analysis of the Interaction Between Albumin-Binding Domain from Streptococcal Protein G and Human Serum Albumin," Protein Science 11(2):206-213, Cold Spring Harbor Laboratory Press, United States (2002).

Lippi, G., et al., "Diagnostic approach to inherited bleeding disorders," Clinical Chemistry and Laboratory Medicine 45(1):2-12, Walter de Gruyter, Germany (2007).

Malik, F., et al., "Polyethylene Glycol (PEG)-modified Granulocyte-Macrophage Colony-stimulating Factor (GM-CSF) with Conserved Biological Activity," Experimental Hematology 20(8):1028-1035, International Society for Experimental Hematology, United States (1992).

(56) References Cited

OTHER PUBLICATIONS

Mannucci, P.M. and Tuddenham, E.G.D., "The Hemophilias—from Royal Genes to Gene Therapy," New England Journal of Medicine 344(23):1773-1779, Massachusetts Medical Society, United States (2001).

Martinelli, N., et al., "Polymorphisms at LDLR Locus may be Associated with Coronary Artery Disease through Modulation of Coagulation Factor VIII Activity and Independently from Lipid Profile," Blood 116(25):5688-5697, The American Society of Hematology, United States (Dec. 2010).

Matsumoto, T., et al., "The measurement of low levels of factor VIII or factor IX in hemophilia A and hemophilia B plasma by clot waveform analysis and thrombin generation assay," Journal of Thrombosis and Haemostasis 4(2):377-384, International Society on Thrombosis and Haemostasis, England (2006).

Mei, B., et al., "Rational Design of a Fully active, Long-Acting PEGylated Factor VIII for Hemophilia A Treatment," Blood 116(2):270-279, The American Society of Hematology, United States (Jul. 2010).

Mize, G.J., et al., "Regulated expression of active biotinylated G-protein coupled receptors in mammalian cells," Protein Expression and Purification 57(2):280-289, Elsevier, United States (2008).

Muller, D. and Kontermann, R.E., "Recombinant Bispecific Antibodies for Cellular Cancer Immunotherapy," Current Opinion in Molecular Therapeutics 9(4):319-326, The Thomson Corporation, United States (2007).

Ormo, M., et al., "Crystal structure of the Aequorea victoria green fluorescent protein," Science 273(5280):1392-1395, Association for the Advancement of Science, United States (1996).

Peters, R.T., et al., "Prolonged Activity of Factor IX as a Monomeric Fc Fusion Protein," Blood, Thrombosis and Hemostasis, 115 (10):2057-2064, Blood 115(10):2057-2064, The American Society of Hematology, United States (Mar. 11, 2010).

Puthenveetil, S., et al., "Yeast display evolution of a kinetically efficient 13-amino acid substrate for lipoic acid ligase," Journal of the American Chemical Society 131(45):16430-16438, American Chemical Society, United States (Nov. 2009).

Rizzo., et al., "Fluorescent protein tracking and detection," In Live Cell Imaging:A Laboratory Manual, pp. 3-34, Cold Spring Harbor Laboratory Press (2010).

Rodriguez-Merchan, E.C. "Management of Musculoskeletal Complications of Hemophilia," Seminars in Thrombosis and Hemostasis 29(1):87-95, Thieme, United States (2003).

Roovers, R.C., et al., "Efficient Inhibition of EGFR Signaling and of Tumour Growth by Antagonistic Anti-EGFR Nanobodies," Cancer Immunology, Immunotherapy 56(3):303-317, Springer Verlag, Germany (2007).

Rosen, S., et al., "Clinical application of a chromogenic substrate method for determination of factor VIII activity," Thrombosis and Haemostasis 54(4):818-823, Stuttgart, Schattauer, Germany (1985).

Schatz, P.J., "Use of peptide libraries to map the substrate specificity of a peptide-modifying enzyme: a 13 residue consensus peptide specifies biotinylation in *Escherichia coli*," Biotechnology 11(10):1138-1143, Nature Publishing Group, New York (1993).

Schulte, S., "Pioneering designs for recombinant coagulation factors," Thrombosis Research 128(1):S9-S12, Elsevier, United States (2011).

Shapiro, A.D., "Recombinant factor IX-Fc fusion protein (rFIXFc) demonstrates safety and prolonged activity in a phase 1/2a study in hemophilia B patients," Blood 119(3):666-672, The American Society of Hematology, United States (2012).

Shimomura, O., et al., "Extraction, purification and properties of aequorin, a bioluminescent protein from the luminous hydromedusan, Aequorea," Journal of Cellular and Comparative Physiology 59:223-239, Wiley-Liss, United States (1962).

Spencer., et al., "Lentiviral Vector Platform for Production of Bioengineered RecombinantCoagulation Factor VIII," Molecular Therapy 19(2):302-309, Nature Publishing Group, England (2011).

Supplementary Partial European Search Report for EP Application No. 12868427, European Patent Office, The Hague, dated Sep. 18, 2015, 8 pages.

Trussel, S., et al., "New Strategy for the Extension of the Serum Half-Life of Antibody Fragments," Bioconjugate Chemistry 20(12):2286-2292, American Chemical Society, United States (2009).

Uttamapinant, C., et al., "A fluorophore ligase for site-specific protein labeling inside living cells," Proceedings of the National Academy of Sciences 107(24):10914-10919, The National Academy of Sciences of the United States (Jun. 2010).

Lozier, J.N., et al., "The Chapel Hill Hemophilia a Dog Colony Exhibits a Factor VIII Gene Inversion," Proceedings of the National Academy of Sciences USA 99(20):12991-12996, National Academy of Sciences, United States (2002).

Powell, J.S., et al., "Safety and Prolonged Activity of Recombinant Factor VIII Fc Fusion Protein in Hemophilia A Patients," Blood 119(13):3031-3037, The American Society of Hematology, United States (2012).

Office Action dated Mar. 9, 2016 in U.S. Appl. No. 14/218,524, filed Mar. 18, 2014.

Office Action dated Nov. 24, 2015 in U.S. Appl. No. 14/317,888, filed Jun. 27, 2014.

Wang, Y., et al., "Receptor-Mediated Activation of a Proinsulin-Transferrin Fusion Protein in Hepatoma Cells," Journal of Controlled Release 155(3):386-392, Elsevier B.V., Netherlands (Nov. 7, 2011).

Holt, L.J., et al., "Anti-Serum Albumin Domain Antibodies for Extending the Half-Lives of Short Lived Drugs," Protein Engineering, Design and Selection 21(5):283-288, Oxford University Press, England (2008).

Gruppo, R.A., et al., "Comparative Effectiveness of Full-length and B-domain Deleted Factor VIII for Prophylaxis—A Meta-analysis," Haemophilia 9(3):251-260, Blackwell Science, England (2003).

International Search Report and Written Opinion for International Patent Application No. PCT/US2014/044718, United States Patent Office, Alexandria, Virginia, dated Nov. 4, 2014, 10 pages.

Database Geneseq [Online] Jan. 12, 2012, "Human B-domain Deleted Factor VIII Protein (5743/Q1638) SEQ:2.". XP002743820, Retrieved from EBI accession No. GSP:AZS50750 Database accession No. AZS5075.

National Heart Lung and Blood Institute, "The Diagnosis, Evaluation and Management of von Willebrand Disease Scientific Overview," accessed at http://www.nhlbi.nih.gov/guidelines/vwd/2scientificoverview.htm, accessed on Oct. 22, 2011.

Genbank, "Homo sapiens von Willebrand factor (VWF), mRNA" NCBI. Reference Sequence: NM_000552.3, accessed at http://www.ncbi.nlm.nih.gov/nuccore/NM_000552.3, accessed on Mar. 29, 2016, 10 pages.

Genbank, "transferrin precursor [*Homo sapiens*]" Accession AAA61140.1, accessed at http://www.ncbi.nlm.nih.gov/protein/AAA61140, accessed on Mar. 29, 2016, 3 pages.

Genbank, "Von Willebrand factor preproprotein [*Homo sapiens*]," NCBI Reference Sequence: NP_000543.2, accessed at http://www.ncbi.nlm.nih.gov/protein/NP_000543.2, accessed on Mar. 29, 2016, 6 pages.

Goudemand, J., et al., "Pharmacokinetic Studies on Wilfactin, a Von Willebrand Factor Concentrate with a Low Factor VIII Content Treated with Three Virus-inactivation/removal Methods," Journal of Thrombosis and Haemostasis 3(10):2219-2227, Blackwell Publishers, England (2005).

Lee, M.T, "Ch. 12: Disorders of Coagulation" in Pediatric Hematology Secrets, Weiner M.A. and Cario, M.S. eds., pp. 47-52, Hanley & Belfus, United States (2001).

Proft, T., "Sortase-mediated protein ligation: an emerging biotechnology tool for protein modification and immobilization," Biotechnology Letters 32:1-10, Springer Science+Business Media B.V., Netherlands (Sep. 2009).

Counts, R. B., et al., "Disulfide Bonds and the Quaternary Structure of Factor VIII/von Willebrand Factor," *J. Clin. Invest.* 62(3):702-09, The American Society for Clinical Investigation, Inc. (1978).

Thermo Scientific, "Instructions: Imidoester Crosslinkers: DMA, DMP, DMS, DTBP," available at https://tools.thermofisher.com/

(56) References Cited

OTHER PUBLICATIONS content/sfs/manuals/MAN0011314_ImidoesterCrsLnk_DMA_DMP_DMS_DTBP_UG.pdf, 2 pages (2012).

Nogami, K., et al., "A novel mechanism of factor VIII protection by von Willebrand factor from activated protein C-catalyzed inactivation," Blood 99(11):3993-98, American Society of Hematology (2002).

Nogami, K., et al., "Relationship between the binding sites for von Willebrand factor, phospholipid, and human factor VIII C2 inhibitor alloantibodies within the factor VIII C2 domain," Int. J. Hematol. 85(4):317-22, Springer (2007).

Office Action dated Mar. 29, 2017, in U.S. Appl. No. 14/413,765, inventor Ekta Seth Chhabra, filed Jul. 10, 2013.

Office Action dated Jul. 21, 2017, in U.S. Appl. No. 14/413,765, inventor Ekta Seth Chhabra, filed Jul. 10, 2013.

Office Action dated May 17, 2017, in U.S. Appl. No. 14/371,948, inventor Ekta Seth Chhabra, filed Jul. 11, 2014.

Office action dated May 23, 2017, in U.S. Appl. No.14/894,108, inventor Ekta Seth Chhabra, filed May 3, 2016.

Engels, et al., "Gene Synthesis," Angewandte Chemie International Edition, 28(6):716-734, VCH Verlagsgesellschaft mbH, Germany (1989).

Pool, J.G., et al., "Ineffectiveness of intramuscularly injected Factor 8 concentrate in two hemophilic patients," The New England Journal of Medicine 275(10):547-548, Massachusetts Medical Society, United States (1966).

Office Action dated Dec. 15, 2017, in U.S. Appl. No. 14/894,108, inventor Ekta Seth Chhabra, filed May 3, 2016.

Office Action dated Jan. 26, 2018, in U.S. Appl. No. 14/895,264 inventor Ekta Seth Chhabra, filed Dec. 2, 2015.

Office Action dated Mar. 30, 2018, in U.S. Appl. No. 14/379,196 inventor Ekta Seth Chhabra, filed Aug. 15, 2014.

Li, X., et al., "The Physical Exchange of Factor VIII (FVIII) between von Willebrand factor and Activated Platelets and the Effect of the FVIII B-Domain on Platelet Binding," Biochemistry 36:10760-10767, Portland Press, United States (1997).

Woof, J.M., et al., "Human antibody-Fc receptor interactions illuminated by crystal structures.," Nat Rev Immunology 4(2):89-99, Nature Publishing Group, United States (2004).

Office Action dated Sep. 25, 2017, in U.S. Appl. No. 14/379,196, Kulman, filed Feb. 15, 2013.

Office Action dated Dec. 12, 2017, in U.S. Appl. No. 14/371,948, Chhabm et al., filed Jan. 12, 2013.

Heinz et al., Factor VIII-eGFP fusion proteins with preserved functional activity for the analysis of the early secretory pathway of factor VIII, Thromb. Haemost. 102:925-35 (2009).

Co-pending, U.S. Appl. No. 16/154,310, inventors Chhabra, F., et al., filing date: To be Assigned (Not Published).

Nieman, M.T., et al., "Interaction of thrombin with PAR1 and PAR4 at the thrombin cleavage site," Biochemistry 46(29):8603-8610, American Chemistry Society, United States (2007).

Office Action dated Jun. 25, 2018 in U.S. Appl. No. 14/371,948 inventor Ekta Seth Chhabra, filed Jul. 11, 2014.

Office Action dated Sep. 7, 2018, in U.S. Appl. No. 14/895,264 inventor Ekta Seth Chhabra, filed Dec. 2, 2015.

Office Action dated Sep. 5, 2018, in U.S. Appl. No. 14/379,196 inventor Ekta Seth Chhabra, filed Aug. 15, 2014.

\* cited by examiner

FIG. 1A
scFVIII
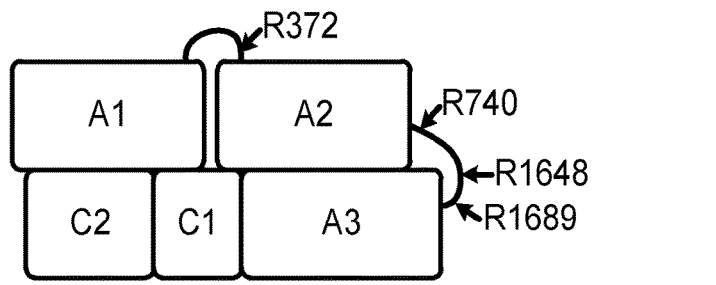
FIG. 1B
FVIII
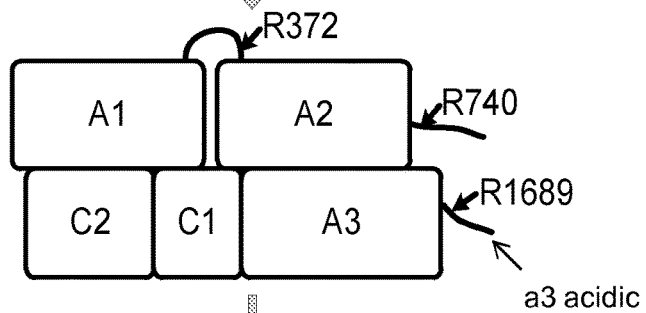
FIG. 1C
FVIIIa
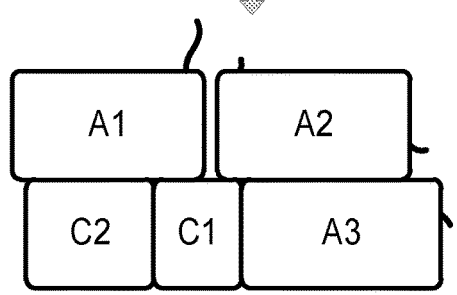
FIG. 1

```
ATRRYYLGAVELSWDYMQSDLGELPVDARFPPRVPKSFPFNTSVVYKKTLFVEFTDHLFN
IAKPRPPWMGLLGPTIQAEVYDTVVITLKNMASHPVSLHAVGVSYWKASEGAEYDDQTSQ
REKEDDKVFPGGSHTYVWQVLKENGPMASDPLCLTYSYLSHVDLVKDLNSGLIGALLVCR
EGSLAKEKTQTLHKFILLFAVFDEGKSWHSETKNSLMQDRDAASARAWPKMHTVNGYVNR
SLPGLIGCHRKSVYWHVIGMGTTPEVHSIFLEGHTFLVRNHRQASLEISPITFLTAQTLL
MDLGQFLLFCHISSHQHDGMEAYVKVDSCPEEPQLRMKNNEEAEDYDDDLTDSEMDVVRF
DDDNSPSFIQIRSVAKKHPKTWVHYIAAEEEDWDYAPLVLAPDDRSYKSQYLNNGPQRIG
RKYKKVRFMAYTDETFKTREAIQHESGILGPLLYGEVGDTLLIIFKNQASRPYNIYPHGI
TDVRPLYSRRLPKGVKHLKDFPILPGEIFKYKWTVTVEDGPTKSDPRCLTRYYSSFVNME
RDLASGLIGPLLICYKESVDQRGNQIMSDKRNVILFSVFDENRSWYLTENIQRFLPNPAG
VQLEDPEFQASNIMHSINGYVFDSLQLSVCLHEVAYWYILSIGAQTDFLSVFFSGYTFKH
KMVYEDTLTLFPFSGETVFMSMENPGLWILGCHNSDFRNRGMTALLKVSSCDKNTGDYYE
DSYEDISAYLLSKNNAIEPRSFSQNSRHPSTRQKQFNATTIPENDIEKTDPWFAHRTPMP
KIQNVSSSDLLMLLRQSPTPHGLSLSDLQEAKYETFSDDPSPGAIDSNNSLSEMTHFRPQ
LHHSGDMVFTPESGLQLRLNEKLGTTAATELKKLDFKVSSTSNNLISTIPSDNLAAGTDN
TSSLGPPSMPVHYDSQLDTTLFGKKSSPLTESGGPLSLSEENNDSKLLESGLMNSQESSW
GKNVSSTESGRLFKGKRAHGPALLTKDNALFKVSISLLKTNKTSNNSATNRKTHIDGPSL
LIENSPSVWQNILESDTEFKKVTPLIHDRMLDKNATALRLNHMSNKTTSSKNMEMVQQK
KEGPIPPDAQNPDMSFFKMLFLPESARWIQRTHGKNSLNSGQGPSPKQLVSLGPEKSVEG
QNFLSEKNKVVVGKGEFTKDVGLKEMVFPSSRNLFLTNLDNLHENNTHNQEKKIQEEIEK
KETLIQENVVLPQIHTVTGTKNFMKNLFLLSTRQNVEGSYDGAYAPVLQDFRSLNDSTNR
TKKHTAHFSKKGEEENLEGLGNQTKQIVEKYACTTRISPNTSQQNFVTQRSKRALKQFRL
PLEETELEKRIIVDDTSTQWSKNMKHLTPSTLTQIDYNEKEKGAITQSPLSDCLTRSHSI
PQANRSPLPIAKVSSFPSIRPIYLTRVLFQDNSSHLPAASYRKKDSGVQESSHFLQGAKK
NNLSLAILTLEMTGDQREVGSLGTSATNSVTYKKVENTVLPKPDLPKTSGKVELLPKVHI
YQKDLFPTETSNGSPGHLDLVEGSLLQGTEGAIKWNEANRPGKVPFLRVATESSAKTPSK
LLDPLAWDNHYGTQIPKEEWKSQEKSPEKTAFKKKDTILSLNACESNHAIAAINEGQNKP
EIEVTWAKQGRTERLCSQNPPVLKRHQREITRTTLQSDQEEIDYDDTISVEMKKEDFDIY
DEDENQSPRSFQKKTRHYFIAAVERLWDYGMSSSPHVLRNRAQSGSVPQFKKVVFQEFTD
GSFTQPLYRGELNEHLGLLGPYIRAEVEDNIMVTFRNQASRPYSFYSSLISYEEDQRQGA
EPRKNFVKPNETKTYFWKVQHHMAPTKDEFDCKAWAYFSDVDLEKDVHSGLIGPLLVCHT
NTLNPAHGRQVTVQEFALFFTIFDETKSWYFTENMERNCRAPCNIQMEDPTFKENYRFHA
INGYIMDTLPGLVMAQDQRIRWYLLSMGSNENIHSIHFSGHVFTVRKKEEYKMALYNLYP
GVFETVEMLPSKAGIWRVECLIGEHLAGMSTLFLVYSNKCQTPLGMASGHIRDFQITAS
GQYGQWAPKLARLHYSGSINAWSTKEPFSWIKVDLLAPMIIHGIKTQGARQKFSSLYISQ
FIIMYSLDGKKWQTYRGNSTGTLMVFFGNVDSSGIKHNIFNPPIIARYIRLHPTHYSIRS
TLRMELMGCDLNSCSMPLGMESKAISDAQITASSYFTNMFATWSPSKARLHLQGRSNAWR
PQVNNPKEWLQVDFQKTMKVTGVTTQGVKSLLTSMYVKEFLISSSQDGHQWTLFFQNGKV
KVFQGNQDSFTPVVNSLDPPLLTRYLRTHPQSWVHQIALRMEVLGCEAQDLY
```

FIG. 3

ATRRYYLGAVELSWDYMQSDLGELPVDARFPPRVPKSFPFNTSVVYKKTLF
EFTVHLFNIAKPRPPWMGLLGPTIQAEVYDTVVITLKNMASHPVSLHAVGV
YWKASEGAEYDDQTSQREKEDDKVFPGGSHTYVWQVLKENGPMASDPLCLT
SYLSHVDLVKDLNSGLIGALLVCREGSLAKEKTQTLHKFILLFAVFDEGKS
HSETKNSLMQDRDAASARAWPKMHTVNGYVNRSLPGLIGCHRKSVYWHVIC
GTTPEVHSIFLEGHTFLVRNHRQASLEISPITFLTAQTLLMDLGQFLLFCF
SSHQHDGMEAYVKVDSCPEEPQLRMKNNEEAEDYDDDLTDSEMDVVRFDDI
SPSFIQIRSVAKKHPKTWVHYIAAEEEDWDYAPLVLAPDDRSYKSQYLNNC
QRIGRKYKKVRFMAYTDETFKTREAIQHESGILGPLLYGEVGDTLLIIFKN
ASRPYNIYPHGITDVRPLYSRRLPKGVKHLKDFPILPGEIFKYKWTVTVEI
PTKSDPRCLTRYYSSFVNMERDLASGLIGPLLICYKESVDQRGNQIMSDKF
VILFSVFDENRSWYLTENIQRFLPNPAGVQLEDPEFQASNIMHSINGYVFI
LQLSVCLHEVAYWYILSIGAQTDFLSVFFSGYTFKHKMVYEDTLTLFPFSC
TVFMSMENPGLWILGCHNSDFRNRGMTALLKVSSCDKNTGDYYEDSYEDIS
YLLSKNNAIEPRSFSQNPPVLKRHQREITRTTLQSDQEEIDYDDTISVEMF
EDFDIYDEDENQSPRSFQKKTRHYFIAAVERLWDYGMSSSPHVLRNRAQSC
VPQFKKVVFQEFTDGSFTQPLYRGELNEHLGLLGPYIRAEVEDNIMVTFRN
ASRPYSFYSSLISYEEDQRQGAEPRKNFVKPNETKTYFWKVQHHMAPTKDF
DCKAWAYFSDVDLEKDVHSGLIGPLLVCHTNTLNPAHGRQVTVQEFALFFT
FDETKSWYFTENMERNCRAPCNIQMEDPTFKENYRFHAINGYIMDTLPGLV
AQDQRIRWYLLSMGSNENIHSIHFSGHVFTVRKKEEYKMALYNLYPGVFET
EMLPSKAGIWRVECLIGEHLHAGMSTLFLVYSNKCQTPLGMASGHIRDFQI
ASGQYGQWAPKLARLHYSGSINAWSTKEPFSWIKVDLLAPMIIHGIKTQGA
QKFSSLYISQFIIMYSLDGKKWQTYRGNSTGTLMVFFGNVDSSGIKHNIFN
PIIARYIRLHPTHYSIRSTLRMELGCDLNSCSMPLGMESKAISDAQITAS
YFTNMFATWSPSKARLHLQGRSNAWRPQVNNPKEWLQVDFQKTMKVGVTT
GVKSLLTSMYVKEFLISSSQDGHQWTLFFQNGKVKVFQGNQDSFTPVVNSI
PPLLTRYLRIHPQSWVHQIALRMEVLGCEAQDLY

FIG. 4

Fig. 6A
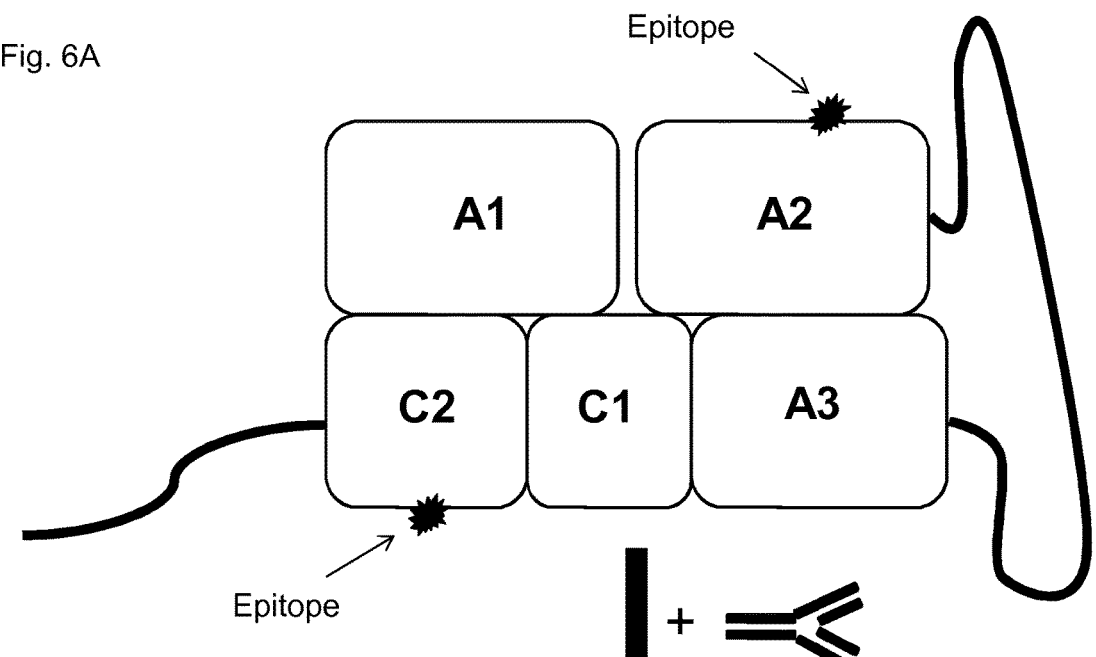
Fig. 6B
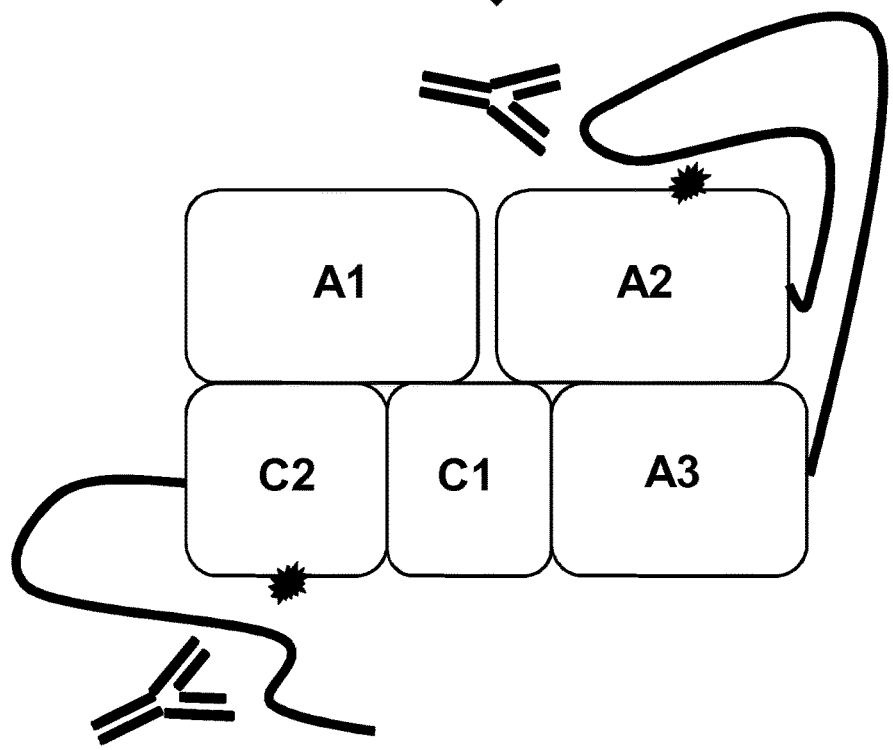
FIG. 6

ATRRYYLGAVELSWDYMQSDLGELPVDARFPPRVPKSFPENTSVVYKKTL
FVEFTVHLFNIAKPRPPWMGLLGPTIQAEVYDTVVITLKNMASHPVSLHA
VGVSYWKASEGAEYDDQTSQREKEDDKVFPGGSHTYVWQVLKENGPMASD
PLCLTYSYLSHVDLVKDLNSGLIGALLVCREGSLAKEKTQTLHKFILLFA
VFDEGKSWHSETKNSLMQDRDAASARAWPKMHTVNGYVNRSLPGLIGCHR
KSVYWHVIGMGTTPEVHSIFLEGHTFLVRNHRQASLEISPITFLTAQTLL
MDLGQFLLFCHISSHQHDGMEAYVKVDSCPEEPQLRMKNNEEAEDYDDDL
TDSEMDVVRFDDDNSPSFIQIRSVAKKHPKTWVHYIAAEEEDWDYAPLVL
APDDRSYKSQYLNNGPQRIGRKYKKVRFMAYTDETFKTREAIQHESGILG
PLLYGEVGDTLLIIFKNQASRPYNIYPHGITDVRPLYSRRLPKGVKHLKD
FPILPGEIFKYKWTVTVEDGPTKSDPRCLTRYYSSFVNMERDLASGLIGP
LLICYKESVDQRGNQIMSDKRNVILFSVFDENRSWYLTENIQRFLPNPAG
VQLEDPEFQASNIMHSINGYVFDSLQLSVCLHEVAYWYILSIGAQTDFLS
VFFSGYTFKHKMVYEDTLTLFPFSGETVFMSMENPGLWILGCHNSDFRNR
GMTALLKVSSCDKNTGDYYEDSYEDISAYLLSKNNAIEPRSFSQNPPVLK
RHQREITRTTLQSDQEEIDYDDTISVEMKKEDFDIYDEDENQSPRSFQKK
TRHYFIAAVERLWDYGMSSSPHVLRNRAQSGSVPQFKKVVFQEFTDGSFT
QPLYRGELNEHLGLLGPYIRAEVEDNIMVTFRNQASRPYSFYSSLISYEE
DQRQGAEPRKNFVKPNETKTYFWKVQHHMAPTKDEFDCKAWAYFSDVDLE
KDVHSGLIGPLLVCHTNTLNPAHGRQVTVQEFALFFTIFDETKSWYFTEN
MERNCRAPCNIQMEDPTFKENYRFHAINGYIMDTLPGLVMAQDQRIRWYL
LSMGSNENIHSIHFSGHVFTVRKKEEYKMALYNLYPGVFETVEMLPSKAG
IWRVECLIGEHLAGMSTLFLVYSNKCQTPLGMASGHIRDFQITASGQYG
QWAPKLARLHYSGSINAWSTKEPFSWIKVDLLAPMIIHGIKTQGARQKFS
SLYISQFIIMYSLDGKKWQTYRGNSTGTLMVFFGNVDSSGIKHNIFNPPI
IARYIRLHPTHYSIRSTLRMELMGCDLNSCSMPLGMESKAISDAQITASS
YFTNMFATWSPSKARLHLQGRSNAWRPQVNNPKEWLQVDFQKTMKVTGVT
TQGVKSLLTSMYVKEFLISSSQDGHQWTLFFQNGKVKVFQGNQDSFTPVV
NSLDPPLLTRYLRIHPQSWVHQIALRMEVLGCEAQDLY

FIG. 8

ATRRYYLGAVELSWDYMQSDLGELPVDARFPPRVPKSFPFNTSVVYKKTL
FVEFTVHLFNIAKPRPPWMGLLGPTIQAEVYDTVVITLKNMASHPVSLHA
VGVSYWKASEGAEYDDQTSQREKEDDKVFPGGSHTYVWQVLKENGPMASD
PLCLTYSYLSHVDLVKDLNSGLIGALLVCREGSLAKEKTQTLHKFILLFA
VFDEGKSWHSETKNSLMQDRDAASARAWPKMHTVNGYVNRSLPGLIGCHR
KSVYWHVIGMGTTPEVHSIFLEGHTFLVRNHRQASLEISPITFLTAQTLL
MDLGQFLLFCHISSHQHDGMEAYVKVDSCPEEPQLRMKNNEEAEDYDDDL
TDSEMDVVRFDDDNSPSFIQIRSVAKKHPKTWVHYIAAEEEDWDYAPLVL
APDDRSYKSQYLNNGPQRIGRKYKKVRFMAYTDETFKTREAIQHESGILG
PLLYGEVGDTLLIIFKNQASRPYNIYPHGITDVRPLYSRRLPKGVKHLKD
FPILPGEIFKYKWTVTVEDGPTKSDPRCLTRYYSSFVNMERDLASGLIGP
LLICYKESVDQRGNQIMSDKRNVILFSVFDENRSWYLTENIQRFLPNPAG
VQLEDPEFQASNIMHSINGYVFDSLQLSVCLHEVAYWYILSIGAQTDFLS
VFFSGYTFKHKMVYEDTLTLFPFSGETVFMSMENPGLWILGCHNSDFRNR
GMTALLKVSSCDKNTGDYYEDSYEDISAYLLSKNNAIEPRSFSQNPPVLK
RHQREITRTTLQSDQEEIDYDDTISVEMKKEDFDIYDEDENQSPRSFQKK
TRHYFIAAVERLWDYGMSSSPHVLRNRAQSGSVPQFKKVVFQEFTDGSFT
QPLYRGELNEHLGLLGPYIRAEVEDNIMVTFRNQASRPYSFYSSLISYEE
DQRQGAEPRKNFVKPNETKTYFWKVQHHMAPTKDEFDCKAWAYFSDVDLE
KDVHSGLIGPLLVCHTNTLNPAHGRQVTVQEFALFFTIFDETKSWYFTEN
MERNCRAPCNIQMEDPTFKENYRFHAINGYIMDTLPGLVMAQDQRIRWYL
LSMGSNENIHSIHFSGHVFTVRKKEEYKMALYNLYPGVFETVEMLPSKAG
IWRVECLIGEHLAGMSTLFLVYSNKCQTPLGMASGHIRDFQITASGQYG
QWAPKLARLHYSGSINAWSTKEPFSWIKVDLLAPMIIHGIKTQGARQKFS
SLYISQFIIMYSLDGKKWQTYRGNSTGTLMVFFGNVDSSGIKHNIFNPPI
IARYIRLHPTHYSIRSTLRMELMGCDLNSCSMPLGMESKAISDAQITASS
YFTNMFATWSPSKARLHLQGRSNAWRPQVNNPKEWLQVDFQKTMKVTGVT
TQGVKSLLTSMYVKEFLISSSQDGHQWTLFFQNGKVKVFQGNQDSFTPVV
NSLDPPLLTRYLRIHPQSWVHQIALRMEVLGCEAQDLY

GASPGTSSTGSPGSSPSASTGTGPGSSPSASTGTGPGTPGSGTASSSPGSSTPSGATGS
PGSSPSASTGTGPGASPGTSSTGSPGTPGSGTASSSPGSSTPSGATGSPGTPGSGTASS
SPGASPGTSSTGSPGASPGTSSTGSPGTPGSGTASSSPGSSTPSGATGSPGASPGTSST
GSPGTPGSGTASSSPGSSTPSGATGSPGSSPSASTGTGPGSSPSASTGTGPGSSTPSGA
TGSPGSSTPSGATGSPGASPGTSSTGSPGASPGTSSTGSPGASPGTSSTGSPGTPGSGT
ASSSPGASPGTSSTGSPGASPGTSSTGSPGASPGTSSTGSPGSSPSASTGTGPGTPGSG
TASSSPGASPGTSSTGSPGASPGTSSTGSPGASPGTSSTGSPGSSTPSGATGSPGSSTP
SGATGSPGASPGTSSTGSPGTPGSGTASSSPGSSTPSGATGSPGSSTPSGATGSPGSST
PSGATGSPGSSPSASTGTGPGASPGTSSTGSPGASPGTSSTGSPGTPGSGTASSSPGAS
PGTSSTGSPGASPGTSSTGSPGASPGTSSTGSPGASPGTSSTGSPGTPGSGTASSSPGS
STPSGATGSPGTPGSGTASSSPGSSTPSGATGSPGTPGSGTASSSPGSSTPSGATGSPG
SSTPSGATGSPGSSPSASTGTGPGSSPSASTGTGPGASPGTSSTGSPGTPGSGTASSSP
GSSTPSGATGSPGSSPSASTGTGPGSSPSASTGTGPGASPGTSSTGSPGASPGTSSTGS
PGSSTPSGATGSPGSSPSASTGTGPGASPGTSSTGSPGSSPSASTGTGPGTPGSGTASS
SPGSSTPSGATGSPGSSTPSGATGSPGASPGTSSTGSP

AG576

PGTPGSGTASSSPGSSTPSGATGSPGSSPSASTGTGPGSSPSASTGTGPGSSTPSGATG
SPGSSTPSGATGSPGASPGTSSTGSPGASPGTSSTGSPGASPGTSSTGSPGTPGSGTAS
SSPGASPGTSSTGSPGASPGTSSTGSPGASPGTSSTGSPGSSPSASTGTGPGTPGSGTA
SSSPGASPGTSSTGSPGASPGTSSTGSPGASPGTSSTGSPGSSTPSGATGSPGSSTPSG
ATGSPGASPGTSSTGSPGTPGSGTASSSPGSSTPSGATGSPGSSTPSGATGSPGSSTPS
GATGSPGSSPSASTGTGPGASPGTSSTGSPGASPGTSSTGSPGTPGSGTASSSPGASPG
TSSTGSPGASPGTSSTGSPGASPGTSSTGSPGASPGTSSTGSPGTPGSGTASSSPGSST
PSGATGSPGTPGSGTASSSPGSSTPSGATGSPGTPGSGTASSSPGSSTPSGATGSPGSS
TPSGATGSPGSSPSASTGTGPGSSPSASTGTGPGASPGTSSTGSPGTPGSGTASSSPGS
STPSGATGSPGSSPSASTGTGPGSSPSASTGTGPGASPGTSSTGS

GASPGTSSTGSPGSSPSASTGTGPGSSPSASTGTGPGTPGSGTASSSPGSSTPSGATGS
PGSSPSASTGTGPGASPGTSSTGSPGTPGSGTASSSPGSSTPSGATGSPGTPGSGTASS
SPGASPGTSSTGSPGASPGTSSTGSPGTPGSGTASSSPGSSTPSGATGSPGASPGTSST
GSPGTPGSGTASSSPGSSTPSGATGSPGSSPSASTGTGPGSSPSASTGTGPGSSTPSGA
TGSPGSSTPSGATGSPGASPGTSSTGSPGASPGTSSTGSPGASPGTSSTGSPGTPGSGT
ASSSPGASPGTSSTGSPGASPGTSSTGSPGASPGTSSTGSPGSSPSASTGTGPGTPGSG
TASSSPGASPGTSSTGSPGASPGTSSTGSPGASPGTSSTGSPGSSTPSGATGSPGSSTP
SGATGSPGASPGTSSTGSPGTPGSGTASSSPGSSTPSGATGSPGSSTPSGATGSPGSST
PSGATGSPGSSPSASTGTGPGASPGTSSTGSPGASPGTSSTGSPGTPGSGTASSSPGAS
PGTSSTGSPGASPGTSSTGS<u>PGASPGTSSTGSPGASPGTSSTGSPGTPGSGTASSSPGS
STPSGATGSPGTPGSGTASSSPGSSTPSGATGSPGTPGSGTASSSPGSSTPSGATGSPG
SSTPSGATGSPGSSPSASTGTGPGSSPSASTGTGPGASPGTSSTGSPGTPGSGTASSSP
GSSTPSGATGSPGSSPSASTGTGPGSSPSASTGTGPGASPGTSSTGSPGASPGTSSTGS
PGSSTPSGATGSPGSSPSASTGTGPGASPGTSSTGSPGSSPSASTGTGPGTPGSGTASS
SPGSSTPSGATGSPGSSTPSGATGS</u>PGASPGTSSTGSP

AG288_1

PGASPGTSSTGSPGASPGTSSTGSPGTPGSGTASSSPGSSTPSGATGSPGTPGSGTA
SSSPGSSTPSGATGSPGTPGSGTASSSPGSSTPSGATGSPGSSTPSGATGSPGSSPS
ASTGTGPGSSPSASTGTGPGASPGTSSTGSPGTPGSGTASSSPGSSTPSGATGSPGS
SPSASTGTGPGSSPSASTGTGPGASPGTSSTGSPGASPGTSSTGSPGSSTPSGATGS
PGSSPSASTGTGPGASPGTSSTGSPGSSPSASTGTGPGTPGSGTASSSPGSSTPSGA
TGS

GASPGTSSTGS<u>PGSSPSASTGTGPGSSPSASTGTGPGTPGSGTASSSPGSSTPSGATGS
PGSSPSASTGTGPGASPGTSSTGSPGTPGSGTASSSPGSSTPSGATGSPGTPGSGTASS
SPGASPGTSSTGSPGASPGTSSTGSPGTPGSGTASSS</u>PGSSTPSGATGSPGASPGTSST
GSPGTPGSGTASSSPGSSTPSGATGSPGSSPSASTGTGPGSSPSASTGTGPGSSTPSGA
TGSPGSSTPSGATGSPGASPGTSSTGSPGASPGTSSTGSPGASPGTSSTGSPGTPGSGT
ASSSPGASPGTSSTGSPGASPGTSSTGSPGASPGTSSTGSPGSSPSASTGTGPGTPGSG
TASSSPGASPGTSSTGSPGASPGTSSTGSPGASPGTSSTGSPGSSTPSGATGSPGSSTP
SGATGSPGASPGTSSTGSPGTPGSGTASSSPGSSTPSGATGSPGSSTPSGATGSPGSST
PSGATGSPGSSPSASTGTGPGASPGTSSTGSPGASPGTSSTGSPGTPGSGTASSSPGAS
PGTSSTGSPGASPGTSSTGSPGASPGTSSTGSPGASPGTSSTGSPGTPGSGTASSSPGS
STPSGATGSPGTPGSGTASSSPGSSTPSGATGSPGTPGSGTASSSPGSSTPSGATGSPG
SSTPSGATGSPGSSPSASTGTGPGSSPSASTGTGPGASPGTSSTGSPGTPGSGTASSSP
GSSTPSGATGSPGSSPSASTGTGPGSSPSASTGTGPGASPGTSSTGSPGASPGTSSTGS
PGSSTPSGATGSPGSSPSASTGTGPGASPGTSSTGSPGSSPSASTGTGPGTPGSGTASS
SPGSSTPSGATGSPGSSTPSGATGSPGASPGTSSTGSP

AG144_2

PGSSPSASTGTGPGSSPSASTGTGPGTPGSGTASSSPGSSTPSGATGSPGSSPSAST
GTGPGASPGTSSTGSPGTPGSGTASSSPGSSTPSGATGSPGTPGSGTASSSPGASPG
TSSTGSPGASPGTSSTGSPGTPGSGTASSS

GSPAGSPTSTEEGTSESATPESGPGTSTEPSEGSAPGSPAGSPTSTEEGTSTEPSEGSA
PGTSTEPSEGSAPGTSESATPESGPGSEPATSGSETPGSEPATSGSETPGSPAGSPTST
EEGTSESATPESGPGTSTEPSEGSAPGTSTEPSEGSAPGSPAGSPTSTEEGTSTEPSEG
SAPGTSTEPSEGSAPGTSESATPESGPGTSTEPSEGSAPGTSESATPESGPGSEPATSG
SETPGTSTEPSEGSAPGTSTEPSEGSAPGTSESATPESGPGTSESATPESGPGSPAGSP
TSTEEGTSESATPESGPGSEPATSGSETPGTSESATPESGPGTSTEPSEGSAPGTSTEP
SEGSAPGTSTEPSEGSAPGTSTEPSEGSAPGTSTEPSEGSAPGTSTEPSEGSAPGSPAG
SPTSTEEGTSTEPSEGSAPGTSESATPESGPGSEPATSGSETPGTSESATPESGPGSEP
ATSGSETPGTSESATPESGPGTSTEPSEGSAPGTSESATPESGPGSPAGSPTSTEEGSP
AGSPTSTEEGSPAGSPTSTEEGTSESATPESGPGTSTEPSEGSAPGTSESATPESGPGS
EPATSGSETPGTSESATPESGPGSEPATSGSETPGTSESATPESGPGTSTEPSEGSAPG
SPAGSPTSTEEGTSESATPESGPGSEPATSGSETPGTSESATPESGPGSPAGSPTSTEE
GSPAGSPTSTEEGTSTEPSEGSAPGTSESATPESGPGTSESATPESGPGTSESATPESG
PGSEPATSGSETPGSEPATSGSETPGSPAGSPTSTEEGTSTEPSEGSAPGTSTEPSEGS
APGSEPATSGSETPGTSESATPESGPGTSTEPSEGSAP

AE576

GSPAGSPTSTEEGTSESATPESGPGTSTEPSEGSAPGSPAGSPTSTEEGTSTEPSEG
SAPGTSTEPSEGSAPGTSESATPESGPGSEPATSGSETPGSEPATSGSETPGSPAGS
PTSTEEGTSESATPESGPGTSTEPSEGSAPGTSTEPSEGSAPGSPAGSPTSTEEGTS
TEPSEGSAPGTSTEPSEGSAPGTSESATPESGPGTSTEPSEGSAPGTSESATPESGP
GSEPATSGSETPGTSTEPSEGSAPGTSTEPSEGSAPGTSESATPESGPGTSESATPE
SGPGSPAGSPTSTEEGTSESATPESGPGSEPATSGSETPGTSESATPESGPGTSTEP
SEGSAPGTSTEPSEGSAPGTSTEPSEGSAPGTSTEPSEGSAPGTSTEPSEGSAPGTS
TEPSEGSAPGSPAGSPTSTEEGTSTEPSEGSAPGTSESATPESGPGSEPATSGSETP
GTSESATPESGPGSEPATSGSETPGTSESATPESGPGTSTEPSEGSAPGTSESATPE
SGPGSPAGSPTSTEEGSPAGSPTSTEEGSPAGSPTSTEEGTSESATPESGPGTSTEP
SEGSAP

GSPAGSPTSTEEGTSESATPESGPGTSTEPSEGSAPGSPAGSPTSTEEGTSTEPSEGSA
PGTSTEPSEGSAPGTSESATPESGPGSEPATSGSETPGSEPATSGSETPGSPAGSPTST
EEGTSESATPESGPGTSTEPSEGSAPGTSTEPSEGSAPGSPAGSPTSTEEGTSTEPSEG
SAPGTSTEPSEGSAPGTSESATPESGPGTSTEPSEGSAPGTSESATPESGPGSEPATSG
SETPGTSTEPSEGSAPGTSTEPSEGSAPGTSESATPESGPGTSESATPESGPGSPAGSP
TSTEEGTSESATPESGPGSEPATSGSETPGTSESATPESGPGTSTEPSEGSAPGTSTEP
SEGSAPGTSTEPSEGSAPGTSTEPSEGSAPGTSTEPSEGSAPGTSTEPSEGSAPGSPAG
SPTSTEEGTSTEPSEGSAPGTSESATPESGPGSEPATSGSETPGTSESATPESGPGSEP
ATSGSETPGTSESATPESGPGTSTEPSEGSAPGTSESATPESGPGSPAGSPTSTEEGSP
AGSPTSTEEGSPAGSPTSTEEGTSESATPESGPGTSTEPSEGSAP<u>GTSESATPESGPGS
EPATSGSETPGTSESATPESGPGSEPATSGSETPGTSESATPESGPGTSTEPSEGSAPG
SPAGSPTSTEEGTSESATPESGPGSEPATSGSETPGTSESATPESGPGSPAGSPTSTEE
GSPAGSPTSTEEGTSTEPSEGSAPGTSESATPESGPGTSESATPESGPGTSESATPESG
PGSEPATSGSETPGSEPATSGSETPGSPAGSPTSTEEGTSTEPSEGSAPGTSTEPSEGS
APGSEPATSGSETPGTSESATPESGPGTSTEPSEGSAP</u>

AE288_2

GTSESATPESGPGSEPATSGSETPGTSESATPESGPGSEPATSGSETPGTSESATPE
SGPGTSTEPSEGSAPGSPAGSPTSTEEGTSESATPESGPGSEPATSGSETPGTSESA
TPESGPGSPAGSPTSTEEGSPAGSPTSTEEGTSTEPSEGSAPGTSESATPESGPGTS
ESATPESGPGTSESATPESGPGSEPATSGSETPGSEPATSGSETPGSPAGSPTSTEE
GTSTEPSEGSAPGTSTEPSEGSAPGSEPATSGSETPGTSESATPESGPGTSTEPSEG
SAP

GSPAGSPTSTEEGTSESATPESGPGTSTEPSEGSAPGSPAGSPTSTEEGTSTEPSEGS
APGTSTEPSEGSAPGTSESATPESGPGSEPATSGSETPGSEPATSGSETPGSPAGSPT
STEEGTSESATPESGPGTSTEPSEGSAPGTSTEPSEGSAPGSPAGSPTSTEEGTSTEP
SEGSAPGTSTEPSEGSAPGTSESATPESGPGTSTEPSEGSAPGTSESATPESGPGSEP
ATSGSETPGTSTEPSEGSAPGTSTEPSEGSAPGTSESATPESGPGTSESATPESGPGS
PAGSPTSTEEGTSESATPESGPGSEPATSGSETPGTSESATPESGPGTSTEPSEGSAP
GTSTEPSEGSAPGTSTEPSEGSAPGTSTEPSEGSAPGTSTEPSEGSAPGTSTEPSEGS
APGSPAGSPTSTEEGTSTEPSEGSAPGTSESATPESGPGSEPATSGSETPGTSESATP
ESGPGSEPATSGSETPGTSESATPESGPGTSTEPSEGSAPGTSESATPESGPGSPAGS
PTSTEEGSPAGSPTSTEEGSPAGSPTSTEEGTSESATPESGPGTSTEPSEGSAPGTSE
SATPESGPGSEPATSGSETPGTSESATPESGPGSEPATSGSETPGTSESATPESGPGT
STEPSEGSAPGSPAGSPTSTEEGTSESATPESGPGSEPATSGSETPGTSESATPESGP
GSPAGSPTSTEEGSPAGSPTSTEEGTSTEPSEGSAPGTSESATPESGPGTSESATPES
GPGTSESATPESGPGSEPATSGSETPGSEPATSGSETPGSPAGSPTSTEEGTSTEPSE
GSAPGTSTEPSEGSAPGSEPATSGSETPGTSESATPESGPGTSTEPSEGSAP

AE144_1A

SPAGSPTSTEEGTSESATPESGPGTSTEPSEGSAPGSPAGSPTSTEEGTSTEPSEGSA
PGTSTEPSEGSAPGTSESATPESGPGSEPATSGSETPGSEPATSGSETPGSPAGSPTS
TEEGTSESATPESGPGTSTEPSEGSAPG

AE144_2B

TSTEPSEGSAPGSPAGSPTSTEEGTSTEPSEGSAPGTSTEPSEGSAPGTSESATPESG
PGTSTEPSEGSAPGTSESATPESGPGSEPATSGSETPGTSTEPSEGSAPGTSTEPSEG
SAPGTSESATPESGPGTSESATPESGPG

AE144_3A

SPAGSPTSTEEGTSESATPESGPGSEPATSGSETPGTSESATPESGPGTSTEPSEGSA
PGTSTEPSEGSAPGTSTEPSEGSAPGTSTEPSEGSAPGTSTEPSEGSAPGTSTEPSEG
SAPGSPAGSPTSTEEGTSTEPSEGSAPG

AE144_4B

TSESATPESGPGSEPATSGSETPGTSESATPESGPGSEPATSGSETPGTSESATPESG
PGTSTEPSEGSAPGTSESATPESGPGSPAGSPTSTEEGSPAGSPTSTEEGSPAGSPTS
TEEGTSESATPESGPGTSTEPSEGSAPG

FIG. 16F

FIG. 17A
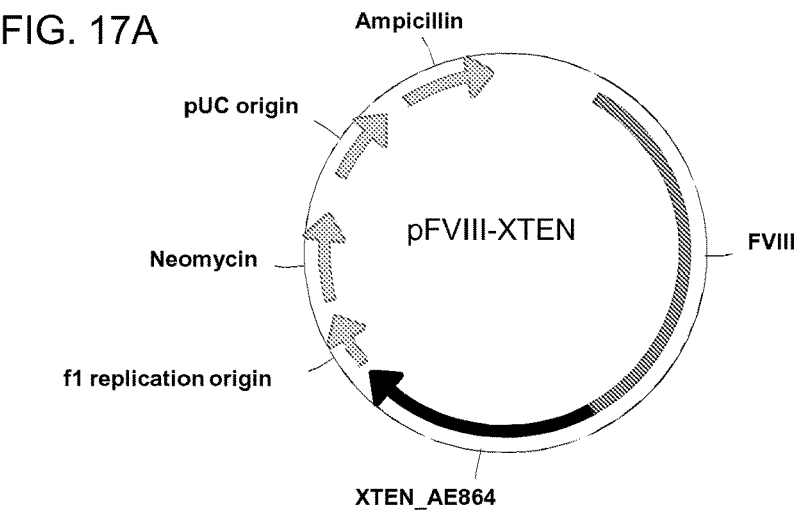
FIG. 17B
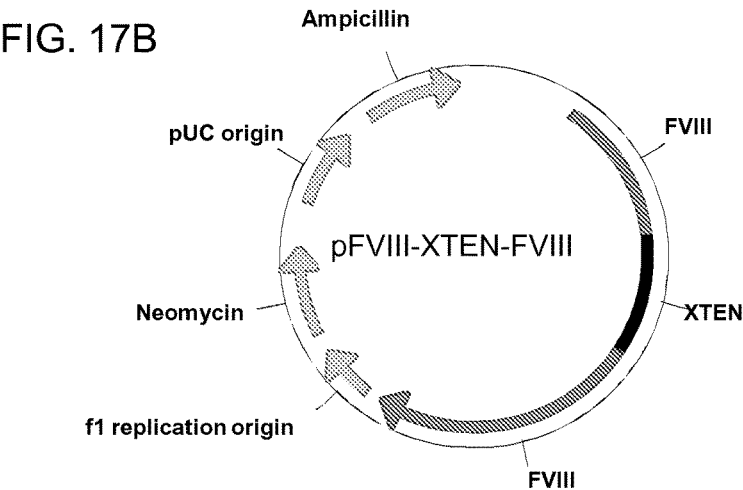
FIG. 17C
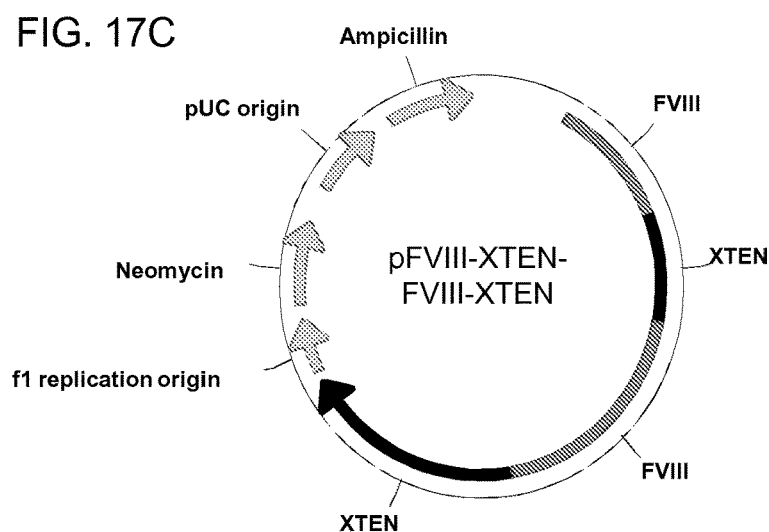
FIG. 17

FIG. 20A Monkey plasma

FIG. 20B Monkey in vivo

FIG. 20C Kidney homogenate

Fig. 24A
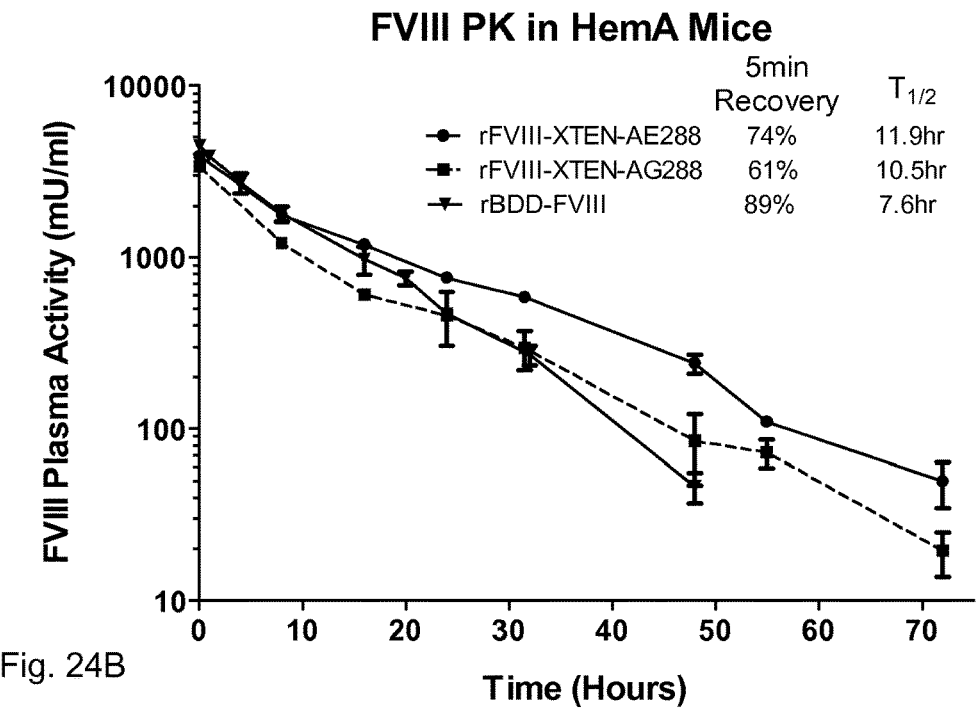
Fig. 24B
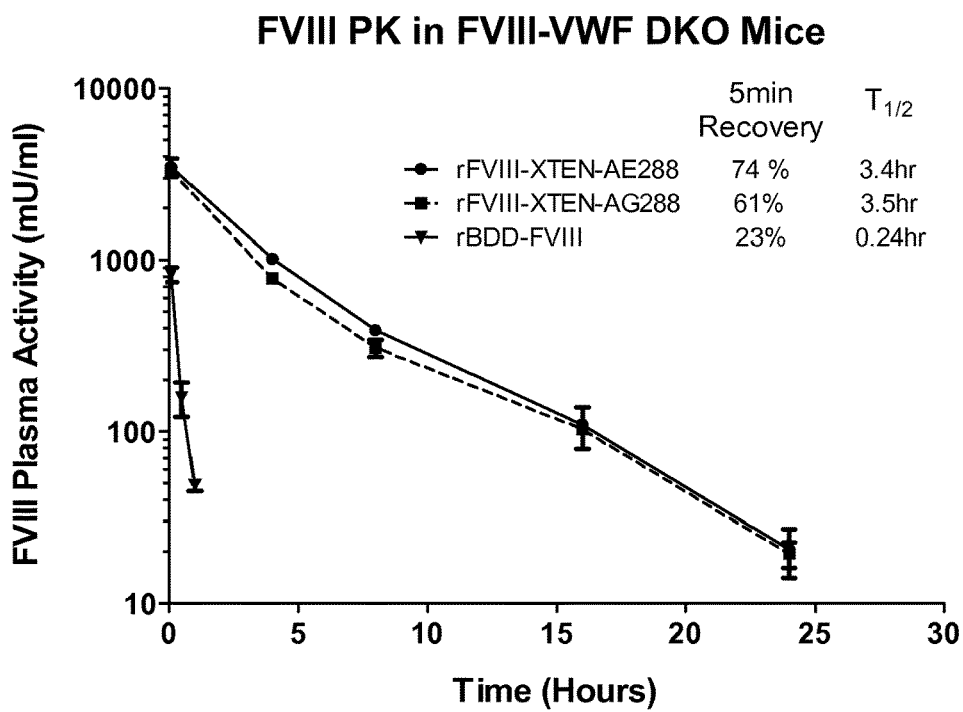
FIG. 24

Fig. 25A
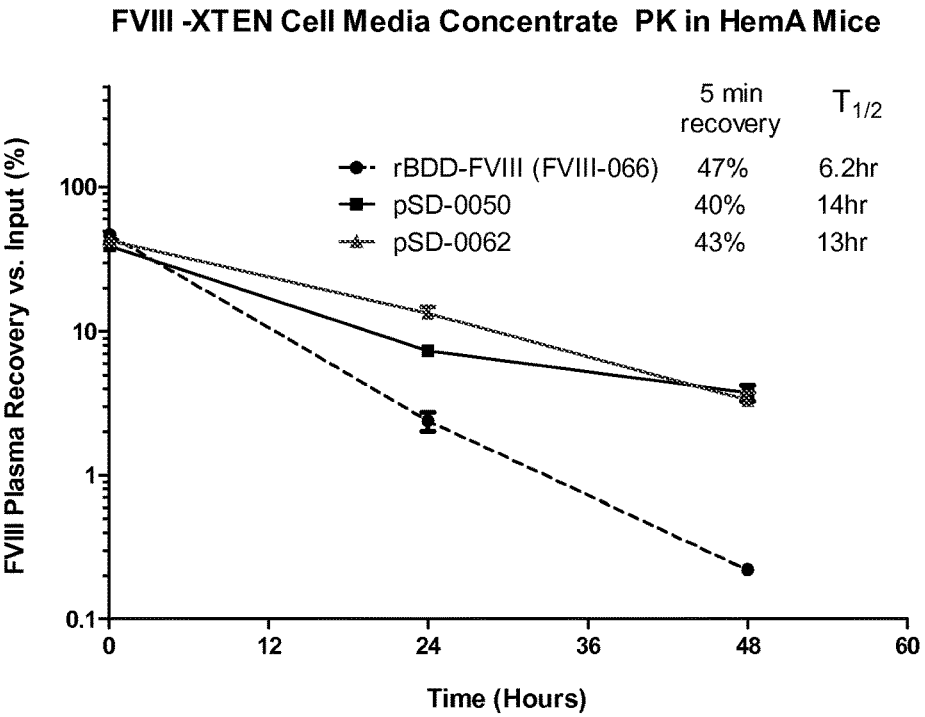
Fig. 25B
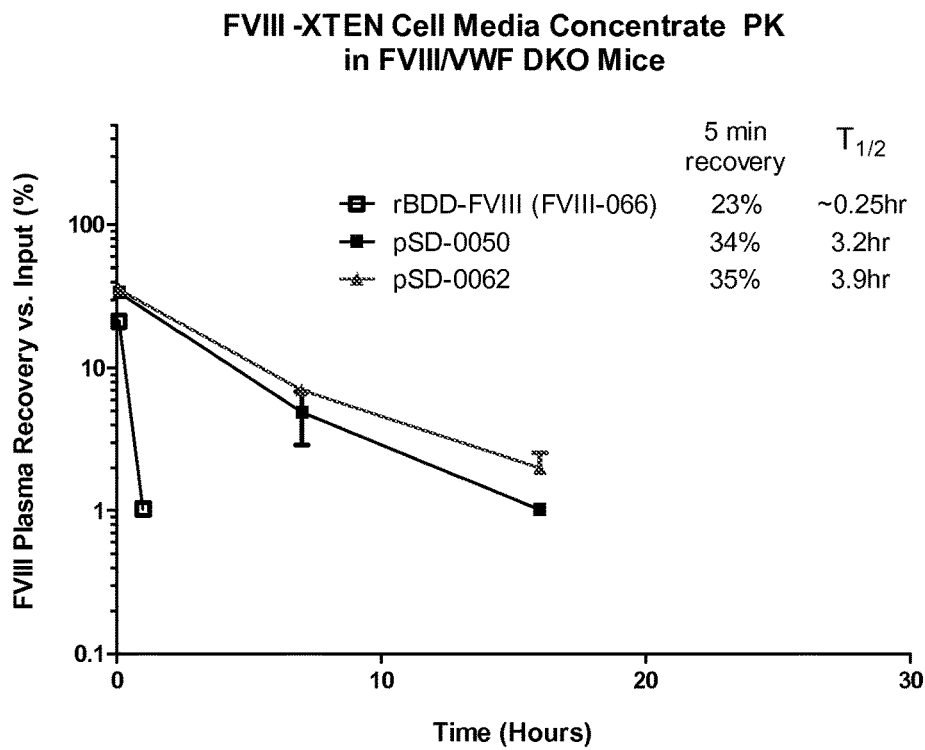
FIG. 25

```
A1  (1)                                                  ATRRYYLGAVELSWD
A2  (373)                                      SVAKKHPKTWVHYIAAEEEDWD
A3  (1649)  EITRTTLQSDQEEIDYDDTISVEMKKEDFDIYDEDENQSPRSFQKKTRHYFIAAVERLWD
                                                   *  :::.*  *   **

A1  (16)    YMQSDLGELPVDARFPPRVPKSFPFNTSVVYKKTLFVEFTDHLFNIAKPR---PPWMGLL
A2  (395)   YAPLVL--APDDRSYKSQYLNNGPQRIGRKYKKVRFMAYTDETFKTREAI---QHESGIL
A3  (1709)  YG---------MSSSPHVLRNRAQSGSVPQFKKVVFQEFTDGSFTQPLYRGELNEHLGLL
             *                   :        :**. *  :** *.         *;*

A1  (73)    GPTIQAEVYDTVVITLKNMASHPVSLHAVGVSYWKASEGAEYDDQTSQREKEDDKVFPGG
A2  (450)   GPLLYGEVGDTLLIIPKNQASRPYNIYPHGITDVRPLY--SRRIPKGVKHLKDFPILPGE
A3  (1760)  GPYIRAEVEDNIMVTFRNQASRPYSFYSSLISYEEDQR--QGAEPR------KNFVKPNE
            **  : .** *.::: ::* **:*  .::.  ::  .           .  : *.

A1  (133)   SHTYVWQVLKENGPMASDPLCLTYSYLSHVDLVKDLNSGLIGALLVCREGSLAK--EKTQ
A2  (508)   IFKYKWTVTVEDGPTKSDPRCLTRYYSSFVNMERDLASGLIGPLLICYKESVDQRGNQIM
A3  (1812)  TKTYFWKVQHHMAPTKDEFDCKAWAYFSDVDLEKDVHSGLIGPLLVCHTNTLNPAHGRQV
              .* *  *     .  .*   *: *   *  *  *::  :*: *****.**:*   ::

A1  (191)   TLHKFILLFAVFDEGKSWHSETKNSLMQDRDAASARAWP------KMHTVNGYVNRSLPG
A2  (568)   SDKRNVILFSVFDENRSWYLTENIQRFLPNPAGVQLEDPEFQASNIMHSINGYVFDSLQ-
A3  (1872)  TVQEFALFFTIFDETKSWYFTENMERNCRAPCNIQMEDPTFKENYRFHAINGYIMDTLPG
            :  :,   ::.*:***  :**:     :.       *              :*::*** :   :*

A1  (245)   LIGCHRKSVYWHVIGMGTTPEVHSIFLEGHTFLVRN---HRQASLEISPITFLTAQTLLM
A2  (627)   LSVCLHEVAYWYILSIGAQTDFLSVFFSGYTFKHKMVYEDTLTLFPFSG---ETVFMSME
A3  (1932)  LVMAQDQRIRWYLLSMGSNENIHSIHFSGHVFTVRKKEEYKMALYNLYPGVFETVEMLPS
              *     *:::.:*:   :. *:.:.*:.*      :           :      *.

A1  (302)   DLGQFLLFCHISSHQHDGMEAYVKVDSCPEEPQLRMKNNEEAEDYDDDLTDSEMDVVRFD
A2  (684)   NPGLWILGCHNSDFRNRGMTALLKVSSCDKNTGDYYEDSYEDISAYLLSKNNAIEPR
A3  (1992)  KAGIWRVECLIGEHLAGMSTLFLVYSN
            . * : *  ,.. :  **  : . * *

A1  (362)   DDNSPSFIQIR

C1  (2020)  KCQTPLGMASGHIRDFQITASGQYG----QWAPKLARLHYSGSINAWS--TKEPFSWIKV
C2  (2173)  SCSMPLGMESKAISDAQITASSYFTNMFATWSPSKARLHLQGRSNAWRPQVNNPKEWLQV
            .*. **** * * ****.. :    *:*. ****  .* ***    .::* .*::*

C1  (2074)  DLLAPMIIHGIKTQGARQKFSSLYISQFIIMYSLDGKKWQTYRGNSTGTLMVFFGNVDSS
C2  (2233)  DFQKTMKVTGVTTQGVKSLLTSMYVKEFLISSSQDGHQWTLFFQN--GKVKVFQGNQDSF
            *:  .*  :  *:.***.:.  ::*:*:.:*:* *    **::*   *  .: ** ** **

C1  (2134)  GIKHNIFNPPIIARYIRLHPTHYSIRSTLRMELMGCDLN---
C2  (2291)  TPVVNSLDPPLLTRYLRIHPQSWVHQIALRMEVLGCEAQDLY
              * ::**:::***:*:*.** :  : :****::**:  :
```

FIG. 37

```
A1   (1)                                                     ATRRYYLGAVELSWD
A2   (373                                    SVAKKHPKTWVHYIAAEEEDWD
A3   (1649)  EITRTTLQSDQEEIDYDDTISVEMKKEDFDIYDEDENQSPRSFQKKTRHYFIAAVERLWD
                     *       :::.*  *   **

A1   (16)    YMQSDLGELPVDARFPPRVPKSFPFNTSVVYKKTLFVEFTDHLFNIAKPR---PPWMGLL
A2   (395)   YAPIVL--APDDRSYKSQYLNNGPQRLGRKYKKVRFMAYTDETFKTREAI---QHESGIL
A3   (1709)  YG--------MSSSPHVLRNRAQSGSVPQFKKVVFQEFTDCSFTQPLYRGELNEHLGLL
             *        :             :**. *  :** *.           *:*

A1   (73)    GPTIQAEVYDTVVITLKNMASHPVSLHAVGVSYWKASEGAEYDDQTSQREKEDDKVFPGG
A2   (450)   GPLLYGEVGDTLLIIFKNQASRFYNIYPHGITDVRPLY--SRRLPKGVKHLKDFPILPGE
A3   (1760)  GPYIRAEVEDNIMVTFRNQASRPYSFYSSLISYEEDQR--QGAEPR------KNFVKPNE
             ** : .** *.::: ::* **:* .:.. ::  .        .  : *.

A1   (133)   SHTYVWQVLKENGPMASDPLCLTYSYLSHVDLVKDLNSGLIGALLVCREGSLAK--EKTQ
A2   (508)   IFKYKWTVTVEDGPTKSDPRCLTRYYSSFVNMERDLASGLIGPLLICYKESVDQRGNQIM
A3   (1812)  TKTYFWKVQHHMAPTKDEFDCKAWAYFSDVDLEKDVHSGLIGPLLVCHTNTLNPAHGRQV
             .* *   . .*   .:   *  :  *  * *::  :*: *****.**:*    ::  :

A1   (191)   TLHKFILLFAVFDEGKSWHSETKNSLMQDRDAASARAWP-L----KMHTVNGYVNRSLPG
A2   (568)   SDKRNVILFSVFDENRSWYLTENIQRFLPNPAGVQLEDPEFQASNIMHSINGYVFDSLQ-
A3   (1872)  TVQEFALFFTIFDETKSWYFTENMERNCRAPCNIQMEDPTFKENYRFHAINGYIMDTLPG
             :  .   ::*:**** :**   :          .          :*:::***:  :*

A1   (245)   LIGCHRKSVYWHVIGMGTTPEVHSIFLEGHTFLVRN---HRQASLEISPITFLTAQTLLM
A2   (627)   LSVCLHEVAYWYILSIGAQTDFLSVFFSGYTFKHKMVYEDTLTLFPFSG---ETVFMSME
A3   (1932)  LVMAQDQRIRWYLLSMGSNENIHSIHFSGHVFTVRKKEEYKMALYNLYPGVFETVEMLPS
             *     :    *:::.:* :.  *:..*:*. *       :    :      *.

A1   (302)   DLGQFLLFCHISSHQHDGMEAYVKVDSCPEEPQLRMKNNEEAEDYDDDLTDSEMDVVRFD
A2   (684)   NPGLWILGCHNSDFRNRGMTALLKVSSCDKNTGDYYEDSYEDISAYLLSKNNAIEPR
A3   (1992)  KAGIWRVECLIGEHLHAGMSTLFLVYSN
             .  *   :  *   ... : ** :. * *

A1   (362)   DDNSPSFIQIR

C1   (2020)  KCQTPLGMASGHIRDFQITASGQYG----QWAPKLARLHYSGSINAWS--TKEPFSWIKV
C2   (2173)  SCSMPLGMESKAISDAQITASSYFTNMFATWSPSKARLHLQGRSNAWRPQVNNPKEWLQV
             .*. **** *  * * *****. :       *:*. ****  .*  ***    .::* .*::*

C1   (2074)  DLLAPMIIHGIKTQGARQKFSSLYISQFIIMYSLDGKKWQTYRGNSTGTLMVFFGNVDSS
C2   (2233)  DFQKTMKVTGVTTQGVKSLLTSMYVKEFLISSQDGHQWTLFFQN--GKVKVFQGNQDSF
             *:    .*  : *:.***.:.  ::*:*:*   * **:*   : *  *.: ** ** **

C1   (2134)  GIKHNIFNPPIIARYIRLHPTHYSIRSTLRMELMGCDLN---
C2   (2291)  TPVVNSLDPPLLTRYLRIHPQSWVHQIALRMEVLGCEAQDLY
               * ::**::: ****:*:**   :  : :****::**:  :
```

FIG. 40

FACTOR VIII COMPOSITIONS AND METHODS OF MAKING AND USING SAME

CROSS-REFERENCE TO RELATED APPLICATIONS

This application is the National Stage of International Application Number PCT/US2012/046326 filed Jul. 11, 2012, which claims priority benefit to U.S. Provisional Application Ser. No. 61/599,400 filed Feb. 15, 2012, both of which are incorporated herein by reference in their entirety.

REFERENCE TO SEQUENCE LISTING SUBMITTED ELECTRONICALLY VIA EFS-WEB

The instant application contains a Substitute Sequence Listing which has been submitted in ASCII format via EFS-Web, and is hereby incorporated by reference in its entirety. Said ASCII copy, created on Aug. 15, 2014, is named 2159.4460001_Sequence_Listing.txt and is 13,343,900 Bytes in size.

BACKGROUND OF THE INVENTION

Factor VIII is an important component of the intrinsic pathway of the blood coagulation cascade. In the circulation, factor VIII is mainly complexed to von Willebrand factor. Upon activation by thrombin, (Factor IIa), it dissociates from the complex to interact with factor IXa in the intrinsic coagulation cascade, which, in turn, activates factor X. Once removed from the von Willebrand factor complex, activated factor VIII is proteolytically inactivated by activated Protein C (APC), factor Xa, and factor IXa, and is quickly cleared from the blood stream. When complexed with normal von Willebrand factor protein, the half-life of factor VIII is approximately 12 hours, whereas in the absence of von Willebrand factor, the half-life of factor VIII is reduced to 2 hours (Tuddenham E G, et al., Br J Haematol. (1982) 52(2):259-267).

In hemophilia, the clotting of blood is disturbed by a lack of certain plasma blood clotting factors. Hemophilia A is a deficiency of factor VIII, and is a recessive sex-linked, X chromosome disorder that represents 80% of hemophilia cases. The standard of care for the management of hemophilia A is replacement therapy with recombinant factor VIII concentrates. Subjects with severe hemophilia A have circulating procoagulant factor VIII levels below 1-2% of normal, and are generally on prophylactic therapy with the aim of keeping factor VIII above 1% between doses, which can usually be achieved by giving factor VIII two to three times a week. Persons with moderately severe hemophilia (factor VIII levels of 2-5% of normal) constitute 25-30% hemophilia incidents and manifest bleeding after minor trauma. Persons with mild hemophilia A (factor VIII levels of 5-40% of normal) comprise 15-20% of all hemophilia incidents, and develop bleeding only after significant trauma or surgery.

The in vivo activity of exogenously supplied factor VIII is limited both by a short protein half-life and inhibitors that bind to the factor VIII and diminish or destroy hemostatic function.

Up to 30% of hemophilia A patients receiving exogenously-supplied factor VIII mount an IgG immune response towards factor VIII (Towfighi, F., et al. Comparative measurement of anti-factor VIII antibody by Bethesda assay and ELISA reveals restricted isotype profile and epitope specificity. Acta Haematol (2005) 114:84-90), which can result in the complete inhibition of its procoagulant activity and/or promote more rapid clearance of the factor VIII (Briet E et al. High titer inhibitors in severe haemophilia A. A meta-analysis based on eight long-term follow-up studies concerning inhibitors associated with crude or intermediate purity factor VIII products. Throm. Haemost. (1994) 72: 162-164). The IgG antibodies, called FVIII inhibitors, are primarily directed towards the A2, A3 and C2 domains (Scandella D et al. Localization of epitopes for human factor VIII inhibitor antibodies by immunoblotting and antibody neutralization. Blood (1989) 74:1618-1626), but can arise against the A1, B and C1 domains, as well. As such, treatment options for patients with FVIII inhibitors are limited.

Large proteins such as factor VIII are normally given intravenously so that the medicament is directly available in the blood stream. It has been previously demonstrated that an unmodified factor VIII injected intramuscularly yielded a maximum circulating level of only 1.4% of the normal plasma level (Pool et al, Ineffectiveness of Intramuscularly Injected Factor VIII Concentrate in Two Hemophilic Patients. New England J. Medicine (1966) 275(10):547-548). Formulations that could be administered other than by the intravenous route would greatly simplify their use, increase safety, and result in substantial cost savings.

Chemical modifications to a therapeutic protein can modify its in vivo clearance rate and subsequent serum half-life. One example of a common modification is the addition of a polyethylene glycol (PEG) moiety, typically coupled to the protein via an aldehyde or N-hydroxysuccinimide (NHS) group on the PEG reacting with an amine group (e.g. lysine side chain or the N-terminus). However, the conjugation step can result in the formation of heterogeneous product mixtures that require extraction, purification and/or other further processes, all of which inevitably affect product yield and quality control. Also, the pharmacologic function of coagulation factors may be hampered if amino acid side chains in the vicinity of its binding site become modified by the PEGylation process. Other approaches include the genetic fusion of an Fc domain to the therapeutic protein, which increases the size of the therapeutic protein, hence reducing the rate of clearance through the kidney. In some cases, the Fc domain confers the ability to bind to, and be recycled from lysosomes by the FcRn receptor, resulting in increased pharmacokinetic half-life. Unfortunately, the Fc domain does not fold efficiently during recombinant expression, and tends to form insoluble precipitates known as inclusion bodies. These inclusion bodies must be solubilized and functional protein must be renatured from the misfolded aggregate, which is a time-consuming, inefficient, and expensive process.

SUMMARY OF THE INVENTION

The present invention relates to novel coagulation factor VIII fusion protein compositions and the uses thereof. Specifically, the compositions provided herein are particularly used for the treatment or improvement of a condition associated with hemophilia A, deficiencies of factor VIII, bleeding disorders and coagulopathies. In one aspect, the present invention provides compositions of isolated fusion proteins comprising a factor VIII (FVIII) and one or more extended recombinant polypeptides (XTEN) wherein the fusion protein exhibits procoagulant activity. A subject XTEN useful for constructing such fusion proteins is typically a polypeptide with a non-repetitive sequence and unstructured conformation. In one embodiment, one or more XTEN is linked to a coagulation factor FVIII ("CF") selected from native human factor VIII, factor VIII B-domain deleted sequences ("FVIII BDD"), and sequence variants thereof (all the foregoing collectively "FVIII" or "CF"), resulting in a recombinant factor VIII-XTEN fusion protein ("CFXTEN"). The factor VIII polypeptide component of the CFXTEN comprises an A1 domain, an A2 domain, a C1 domain, a C2 domain, and optionally a B domain or a portion thereof. In some embodiments, the FVIII is further characterized by delineation of the aforementioned domains to comprise an acidic a1, a2 and a3 spacer. In another embodiment, the present disclosure is directed to pharmaceutical compositions comprising the fusion proteins and the uses thereof in methods and regimens for treating factor VIII-related conditions. The CFXTEN compositions have enhanced pharmacokinetic and pharmacologic properties compared to FVIII not linked to XTEN, which may permit more convenient dosing and improved efficacy.

In a first aspect, the invention relates to recombinant factor VIII fusion proteins comprising a factor VIII polypeptide and one or more extended recombinant polypeptide (XTEN) linked to the factor VIII. In some embodiments, the invention provides recombinant factor VIII fusion proteins comprising a factor VIII polypeptide and at least one extended recombinant polypeptide (XTEN), wherein said factor VIII polypeptide comprises an A1 domain including an a1 acidic spacer region, an A2 domain including an a2 acidic spacer region, an A3 domain including an a3 acidic spacer region, C1 domain, C2 domain and optionally all or a portion of B domain, and wherein said at least one XTEN is linked to said factor VIII polypeptide at (i) the C-terminus of said factor VIII polypeptide; (ii) within B domain of said factor VIII polypeptide if all or a portion of B domain is present; (iii) within the A1 domain of said factor VIII polypeptide; (iv) within the A2 domain of said factor VIII polypeptide; (v) within the A3 domain of said factor VIII polypeptide; (vi) within the C1 domain of said factor VIII polypeptide; (vii) within the C2 domain of said factor VIII polypeptide; (viii) at the N-terminus of said factor VIII polypeptide, or (ix) between two domains of said factor VIII polypeptide, wherein the fusion protein retains at least about 10%, 20%, 30%, 40%, 50%, 60%, 70%, 80%, 90%, 100%, 200%, 300%, 400%, or 500% of the procoagulant activity, when measured by an in vitro coagulation assay, compared to a corresponding factor VIII not linked to XTEN. In one embodiment, in the foregoing recombinant factor VIII fusion protein the at least one XTEN is linked to said factor VIII polypeptide at a site at or within 1 to 6 amino acids of a site selected from Table 5, Table 6, Table 7, Table 8, and Table 9. In other embodiments, the invention provides recombinant factor VIII fusion proteins comprising a factor VIII polypeptide and at least a first extended recombinant polypeptide (XTEN), wherein said factor VIII polypeptide comprises an A1 domain including an a1 acidic spacer region, an A2 domain including an a2 acidic spacer region, an A3 domain including an a3 acidic spacer region, a C1 domain, a C2 domain and optionally all or a portion of a B domain, and wherein said first XTEN is linked to said factor VIII polypeptide at (i) the C-terminus of said factor VIII polypeptide; (ii) within the B domain of said factor VIII polypeptide if all or a portion of the B domain is present; (iii) within the A1 domain of said factor VIII polypeptide; (iv) within the A2 domain of said factor VIII polypeptide; (v) within the A3 domain of said factor VIII polypeptide; (vi) within the C1 domain of said factor VIII polypeptide; or (vii) within the C2 domain of said factor VIII polypeptide; and when compared to a corresponding factor VIII protein not linked to XTEN, the fusion protein (a) retains at least about 10%, 20%, 30%, 40%, 50%, 60%, 70%, 80%, 90% 100%, 200%, 300%, 400%, or 500% of the procoagulant activity in an in vitro coagulation assay described herein or other such assays known in the art, and/or (b) exhibits reduced binding to an anti-factor VIII antibody in an in vitro binding assay described herein or other such assays known in the art. In one embodiment, in the foregoing recombinant factor VIII fusion protein the at least one XTEN is linked to said factor VIII polypeptide at a site at or within 1 to 6 amino acids of a site selected from Table 5, Table 6, Table 7, Table 8, and Table 9. In other embodiments, the invention provides recombinant factor VIII fusion proteins comprising a factor VIII polypeptide and at least a first extended recombinant polypeptide (XTEN), wherein said factor VIII polypeptide comprises an A1 domain including an a1 acidic spacer region, an A2 domain including an a2 acidic spacer region, an A3 domain including an a3 acidic spacer region, a C1 domain, a C2 domain and optionally all or a portion of a B domain, and wherein said first XTEN is linked to said factor VIII polypeptide at an insertion site selected from Table 6 and Table 7 and wherein the fusion protein retains at least about 10%, 20%, 30%, 40%, 50%, 60%, 70%, 80%, 90%, 100%, 200%, 300%, 400%, or 500% of the procoagulant activity, when measured by an in vitro coagulation assay described herein or other such assays known in the art, compared to a corresponding factor VIII protein not linked to XTEN. Non-limiting examples of the factor VIII protein not linked to XTEN includes native FVIII, BDD FVIII, pBC100 and sequences from Table 1. In another embodiment of the recombinant factor VIII fusion protein, the factor VIII polypeptide has at least about 80% sequence identity, or about 90%, or about 91%, or about 92%, or about 93%, or about 94%, or about 95%, or about 96%, or about 97%, or about 98%, or about 99%, to about 100% sequence identity to a sequence selected from the group consisting of the sequences of Table 1, the sequence depicted in FIG. 3, and the sequence depicted in FIG. 4, when optimally aligned. In yet another embodiment, the fusion protein comprises at least another XTEN linked to said factor VIII polypeptide at the C-terminus of said factor VIII polypeptide or within or optionally replacing the B domain of said factor VIII polypeptide. In a specific embodiment, the fusion protein comprises at least one XTEN sequence located within or optionally replacing the B domain of said factor VIII polypeptide. In another specific embodiment, the fusion protein comprises at least one XTEN sequence linked to said factor VIII polypeptide at the C-terminus of said factor VIII polypeptide. In one embodiment, the recombinant factor VIII fusion protein comprises a B-domain deleted variant of human factor VIII, wherein the B-domain deletion starts from a first position at about amino acid residue number 741 to about 750 and ending at a second position at amino acid residue number 1635 to about 1648 with reference to full-length human factor VIII sequence as set forth in FIG. 3. In another embodiment, the recombinant factor VIII fusion protein comprises a first XTEN sequence linked to said factor VIII polypeptide at the C-terminus of said factor VIII polypeptide, and at least a second XTEN within or replacing the B domain of said factor VIII polypeptide, wherein the second XTEN is linked to the C-terminal end of about amino acid residue number 741 to about 750 and to the N-terminal end of amino acid residue numbers 1635 to about 1648 with reference to full-length human factor VIII sequence as set forth in FIG. 3, wherein the cumulative length of the XTEN is at least about 100 amino acid residues. In one embodiment, in the foregoing fusion protein, the second XTEN links the factor VIII amino acids between N745 to P1640 or between S743 to Q1638 or between P747 to V1642 or between N745 and Q1656 or between N745 and S1657 or between N745 and T1667 or between N745 and Q1686 or between R747 and V1642 or between T751 and T1667. In one embodiment, the recombinant factor VIII fusion protein comprises a sequence having at least about 80% sequence identity, or at least about 90%, or at least about 91%, or at least about 92%, or at least about 93%, or at least about 94%, or at least about 95%, or at least about 96%, or at least about 97%, or at least about 98%, or at least about 99%, to about 100% sequence identity compared to a sequence of comparable length selected from Table 21, when optimally aligned. In another embodiment, the recombinant factor VIII fusion protein comprises at least a second XTEN, optionally a third XTEN, optionally a fourth XTEN, optionally a fifth XTEN and optionally a sixth XTEN, wherein each of the second, third, fourth, fifth, or sixth XTEN is linked to said factor VIII polypeptide at a second, third, fourth, fifth, or sixth site selected from the group consisting of an insertion site from Table 5, Table 6, Table 7 Table 8, and Table 9; a location within 6 amino acids of amino acid residue 32, 220, 224, 336, 339, 390, 399, 416, 603, 1656, 1711, 1725, 1905 and 1910 of mature factor VIII; a location between any two adjacent domains of said factor VIII polypeptide, wherein said two adjacent domains are selected from the group consisting of A1 and A2 domains, A2 and B domains, B and A3 domains, A3 and C1 domains, and C1 and C2 domains; a location within the B domain of said factor VIII polypeptide, wherein the second XTEN is linked to the C-terminal end of about amino acid residue number 741 to about 750 and to the N-terminal end of amino acid residue numbers 1635 to about 1648 of a native factor VIII sequence; and the C-terminus of said factor VIII polypeptide. In one embodiment, the first XTEN is separated from the second XTEN by at least 10 amino acids, at least 50 amino acids, at least 100 amino acids, at least 200 amino acids, at least 300 amino acids, or at least 400 amino acids. In one embodiment of the recombinant factor VIII fusion protein that comprises at least a second XTEN, optionally a third XTEN, optionally a fourth XTEN, optionally a fifth XTEN and optionally a sixth XTEN, each XTEN has at least about 80% sequence identity, or at least about 90%, or at least about 91%, or at least about 92%, or at least about 93%, or at least about 94%, or at least about 95%, or at least about 96%, or at least about 97%, or at least about 98%, or at least about 99%, or about 100% sequence identity compared to an XTEN of comparable length selected from the group consisting of the sequences in Table 4, Table 13, Table 14, Table 15, Table 16, and Table 17, when optimally aligned. In yet another embodiment of the recombinant factor VIII fusion protein that comprises at least a second XTEN, optionally a third XTEN, optionally a fourth XTEN, optionally a fifth XTEN and optionally a sixth XTEN, In preferred embodiments, the recombinant factor VIII fusion protein exhibits a terminal half-life at least about 3 hours, or 4 hours, or 6 hours, or 12 hours, or 13 hours, or 14 hours, or 16 hours, or 24 hours, or 48 hours, or 72 hours, or 96 hours, or 120 hours, or 144 hours, or 7 days, or 14 days, or 21 days when administered to a subject, wherein said subject is selected from human and factor VIII/von Willebrand factor double knock-out mouse. Further, in the embodiments of this paragraph, the fusion protein exhibits reduced binding to anti-factor VIII antibody or greater retained procoagulant activity, or both as compared to a corresponding factor VIII not linked to XTEN. In one embodiment, the procoagulant activity of the recombinant factor VIII fusion protein is at least 30%, or 40%, 50%, 80%, 100%, 200%, 300%, 400%, or 500% greater procoagulant activity in the presence of the anti-FVIII antibody compared to a corresponding factor VIII not linked to XTEN when each are assayed by an in vitro coagulation assay. In one embodiment, the reduced binding of the fusion protein to anti-factor VIII antibody is determined using a Bethesda assay using anti-factor VIII antibody selected from the group consisting of the antibodies of Table 10 and polyclonal antibody from a hemophilia A patient with factor VIII inhibitors, wherein the reduced binding and retained procoagulant activity of the fusion protein is evidenced by a lower Bethesda titer of at least about 2, 4, 6, 8, 10, 12, 15, 20, 30, 40, 50, 60, 70, 80, 100, or 200 Bethesda units for the fusion protein compared to that for the factor VIII not linked to XTEN.

In one embodiment, the recombinant factor VIII fusion protein can, for example, comprise one or more XTEN wherein the XTEN has at least about 80% sequence identity, or about 90%, or about 91%, or about 92%, or about 93%, or about 94%, or about 95%, or about 96%, or about 97%, or about 98%, or about 99%, to about 100% sequence identity compared to one or more XTEN of comparable length selected from Table 4, Table 13, Table 14, Table 15, Table 16, and Table 17, when optimally aligned.

In another aspect, the invention relates to recombinant factor VIII fusion proteins comprising FVIII and one or more XTEN in specific N- to C-terminus configurations. In one embodiment of the CFXTEN composition, the invention provides a recombinant factor VIII fusion protein of formula I:

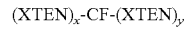
$$(XTEN)_x\text{-}CF\text{-}(XTEN)_y \qquad\qquad I$$

wherein independently for each occurrence, CF is a factor VIII as defined herein, including sequences having at least about 80%, or at least about 90%, or at least about 95%, or at least about 96%, or at least about 97%, or at least about 98%, or at least about 99% or 100% sequence identity with sequenced from Table 1; x is either 0 or 1 and y is either 0 or 1 wherein x+y≥1; and XTEN is an extended recombinant polypeptide as described herein, including, but not limited to sequences having at least about 80%, or at least about 90%, or at least about 95%, or at least about 96%, or at least about 97%, or at least about 98%, or at least about 99% or 100% sequence identity to sequences set forth in Table 4. Accordingly, the CFXTEN fusion composition can have XTEN-CF, XTEN-CF-XTEN, or CF-XTEN configurations.

In another embodiment of the CFXTEN composition, the invention provides a recombinant factor VIII fusion protein of formula II:

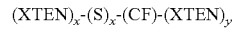
$$(XTEN)_x\text{-}(S)_x\text{-}(CF)\text{-}(XTEN)_y \qquad\qquad II$$

wherein independently for each occurrence, CF is a factor VIII as defined herein, including sequences having at least about 80%, or at least about 90%, or at least about 95%, or at least about 96%, or at least about 97%, or at least about 98%, or at least about 99% or 100% sequence identity to sequences set forth in Table 1; S is a spacer sequence having between 1 to about 50 amino acid residues that can optionally include a cleavage sequence or amino acids compatible with restrictions sites; x is either 0 or 1 and y is either 0 or 1 wherein x+y≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4.

In another embodiment of the CFXTEN composition, the invention provides a recombinant factor VIII fusion protein, wherein the fusion protein is of formula III:

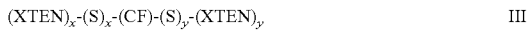    III wherein independently for each occurrence, CF is a factor VIII as defined herein, including sequences having at least about 80%, or at least about 90%, or at least about 95%, or at least about 96%, or at least about 97%, or at least about 98%, or at least about 99% or 100% sequence identity to sequence set for in Table 1; S is a spacer sequence having between 1 to about 50 amino acid residues that can optionally include a cleavage sequence or amino acids compatible with restrictions sites; x is either 0 or 1 and y is either 0 or 1 wherein x+y≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4.

In another embodiment of the CFXTEN composition, the invention provides a recombinant factor VIII fusion protein of formula IV:

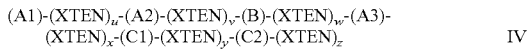    IV wherein independently for each occurrence, A1 is an A1 domain of FVIII; A2 is an A2 domain of FVIII; A3 is an A3 domain of FVIII; B is a B domain of FVIII which can be a fragment or a splice variant of the B domain; C1 is a C1 domain of FVIII; C2 is a C2 domain of FVIII; v is either 0 or 1; w is either 0 or 1; x is either 0 or 1; y is either 0 or 1; y is either 0 or 1 with the proviso that u+v+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4.

In another embodiment of the CFXTEN composition, the invention provides a recombinant factor VIII fusion protein of formula V:

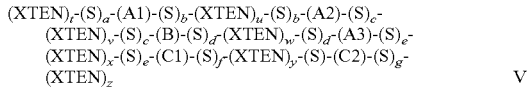    V wherein independently for each occurrence, A1 is an A1 domain of FVIII; A2 is an A2 domain of FVIII; A3 is an A3 domain of FVIII; B is a B domain of FVIII which can be a fragment or a splice variant of the B domain; C1 is a C1 domain of FVIII; C2 is a C2 domain of FVIII; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; g is either 0 or 1; t is either 0 or 1; u is either 0 or 1; v is either 0 or 1; w is 0 or 1, x is either 0 or 1; y is either 0 or 1; z is either 0 or 1 with the proviso that t+u+v+w+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4. In another embodiment of formula V, the spacer sequence is glycine or a sequence selected from Tables 11 and 12.

In another embodiment of the CFXTEN composition, the invention provides a recombinant factor VIII fusion protein of formula VI:

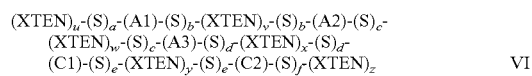    VI wherein independently for each occurrence, A1 is an A1 domain of FVIII; A2 is an A2 domain of FVIII; A3 is an A3 domain of FVIII; C1 is a C1 domain of FVIII; C2 is a C2 domain of FVIII; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; u is either 0 or 1; v is either 0 or 1; w is 0 or 1, x is either 0 or 1; y is either 0 or 1; z is either 0 or 1 with the proviso that u+v+w+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4. In another embodiment of formula V, the spacer sequence is glycine or a sequence selected from Tables 11 and 12.

In another embodiment of the CFXTEN composition, the invention provides a recombinant factor VIII fusion protein of formula VII:

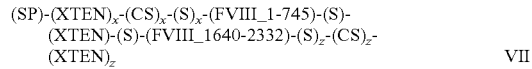    VII wherein independently for each occurrence, SP is a signal peptide, preferably with sequence MQIELSTCFFLCLLR-FCFS (SEQ ID NO: 1611), CS is a cleavage sequence listed in Table 12, S is a spacer sequence having between 1 to about 50 amino acid residues that can optionally include amino acids compatible with restrictions sites, "FVIII_1-745" is residues 1-745 of Factor VIII and "FVIII_1640-2332" is residues 1640-2332 of FVIII, x is either 0 or 1, y is either 0 or 1, and z is either 0 or 1, wherein x+y+z>2; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity sequences set forth in Table 4. In one embodiment of formula VII, the spacer sequence is GPEGPS (SEQ ID NO: 1612). In another embodiment of formula V, the spacer sequence is glycine or a sequence selected from Tables 11 and 12.

In another embodiment of the CFXTEN composition, the invention provides a recombinant factor VIII fusion protein of formula VIII:

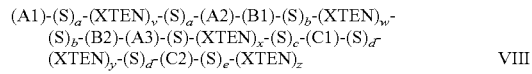    VIII wherein independently for each occurrence, A1 is an A1 domain of FVIII; A2 is an A2 domain of FVIII; B1 is a fragment of the B domain that can have from residue 741 to 743-750 of FVIII or alternatively from about residue 741 to about residues 745 of FVIII; B2 is a fragment of the B domain that can have from residues 1635-1686 to 1689 of FVIII or alternatively from about residue 1640 to about residues 1689 of FVIII; A3 is an A3 domain of FVIII; C1 is a C1 domain of FVIII; C2 is a C2 domain of FVIII; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; u is either 0 or 1; v is either 0 or 1; w is 0 or 1, x is either 0 or 1; y is either 0 or 1; z is either 0 or 1 with the proviso that u+v+w+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4. In one embodiment of formula VIII, the spacer sequence is GPEGPS (SEQ ID NO: 1612). In another embodiment of formula V, the spacer sequence is glycine or a sequence selected from Tables 11 and 12.

In another embodiment of the CFXTEN composition, the invention provides a recombinant factor VIII fusion protein of formula IX:

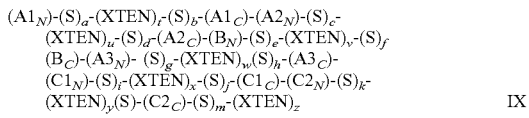
IX wherein independently for each occurrence, $A1_N$ is a fragment of the A1 domain from at least residue number 1 (numbered relative to native, mature FVIII) to no more than residue number 371, $A1_c$ is a fragment of the A1 domain from at least residue number 2 to no more than residue number 372, with the priviso that no sequence of the $A1_N$ fragment is duplicated in the $A1_c$ is a fragment; $A2_N$ is a fragment of the A2 domain from at least residue number 373 to no more than residue number 739, $A2_e$ is a fragment of the A2 domain from at least residue number 374 to no more than residue number 740, with the priviso that no sequence of the $A2_N$ fragment is duplicated in the $A2_e$ is a fragment; $B_N$ is a fragment of the B domain from at least residue number 741 to no more than residue number 1647, Be is a fragment of the B domain from at least residue number 742 to no more than residue number 1648, with the priviso that no sequence of the $B_N$ fragment is duplicated in the Be is a fragment; $A3_N$ is a fragment of the A3 domain from at least residue number 1649 to no more than residue number 2019, $A3_e$ is a fragment of the A3 domain from at least residue number 1650 to no more than residue number 2019, with the priviso that no sequence of the $A3_N$ fragment is duplicated in the $A3_e$ is a fragment; $C1_N$ is a fragment of the C1 domain from at least residue number 2020 to no more than residue number 2171, C1, is a fragment of the C1 domain from at least residue number 2021 to no more than residue number 2172, with the priviso that no sequence of the $C1_N$ fragment is duplicated in the C1, is a fragment; $C2_N$ is a fragment of the C2 domain from at least residue number 2173 to no more than residue number 2331, C2, is a fragment of the C2 domain from at least residue number 2174 to no more than residue number 2332, with the priviso that no sequence of the $C2_N$ fragment is duplicated in the C2, is a fragment; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; g is either 0 or 1; h is either 0 or 1; i is either 0 or 1; j is either 0 or 1; k is either 0 or 1; l is either 0 or 1; m is either 0 or 1; t is either 0 or 1; u is either 0 or 1; v is either 0 or 1; w is 0 or 1, x is either 0 or 1; y is either 0 or 1; z is either 0 or 1 with the proviso that t+u+v+w+x+y+z≥1; and XTEN is an extended recombinant polypeptide as described herein including, but not limited to sequences having at least about 80% sequence identity, or about 90%, or about 91%, or about 92%, or about 93%, or about 94%, or about 95%, or about 96%, or about 97%, or about 98%, or about 99%, to about 100% sequence identity compared to one or more XTEN of comparable length selected from Table 4. In one embodiment of formula IX, the spacer sequence is GPEGPS (SEQ ID NO: 1612). In another embodiment of formula V, the spacer sequence is glycine or a sequence selected from Tables 11 and 12. In another embodiment of formula IX, Z is 1. In another embodiment of the fusion protein of formula IX V is 1 and the XTEN is linked to the C-terminal end of about amino acid residue number 741 to about 750 and to the N-terminal end of amino acid residue numbers 1635 to about 1648 with reference to full-length human factor VIII sequence as set forth in FIG. 3. In another embodiment of the fusion protein of formula IX, the sum of t, u, v, w, x, y, and z equals 2, 3, 4, 5, or 6. In another embodiment of formula IX, the sum of t, u, v, w, x, y, and z equals 2, and v is 1 and z is 1. In another embodiment of the fusion protein of formula IX, the sum of t, u, v, w, x, y, and z equals 3, v and z each equal 1, and either t, u, w, x or y is 1. In another embodiment of formula IX, the sum of t, u, v, w, x, y, and z equals 4, v and w and z each equal 1, and two of t, u, x or y is 1. In another embodiment of the fusion protein of formula IX, the cumulative length of the XTENs is between about 84 to about 3000 amino acid residues. In another embodiment of formula IX, at least one XTEN is inserted immediately downstream of an amino acid which corresponds to an amino acid in mature native human factor VIII selected from the group consisting of amino acid residue number 32, 220, 224, 336, 339, 399, 416, 603, 1656, 1711, 1725, 1905 and 1910. In another embodiment of the fusion protein formula IX, each XTEN is linked to said fusion protein at sites selected from Table 5, Table 6, Table 7, Table 8, and Table 9. In another embodiment of the fusion protein formula IX, each XTEN has at least about 80%, or about 90%, or at least about 91%, or at least about 92%, or at least about 93%, or at least about 94%, or at least about 95%, or at least about 96%, or at least about 97%, or at least about 98%, or at least about 99%, or about 100% sequence identity compared to an XTEN of comparable length selected from the group consisting of the sequences in Table 4, Table 13, Table 14, Table 15, Table 16, and Table 17, when optimally aligned.

In another embodiment of the CFXTEN composition, the invention provides a first recombinant factor VIII polypeptide of formula X:

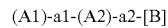     X and a second polypeptide comprising Formula XI:

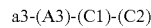     XI wherein the first polypeptide and the second polypeptide are fused or exist as a heterodimer; wherein, A1 is an A1 domain of factor VIII; A2 is an A2 domain of factor VIII; [B] is a B domain of factor VIII, a fragment thereof, or is deleted; A3 is an A3 domain of factor VIII; C1 is a C1 domain of factor VIII; C2 is a C2 domain of factor VIII; a1, a2, and a3 are acidic spacer regions; wherein the A1 domain comprises an XTEN permissive loop-1 (A1-1) region and an XTEN permissive loop-2 (A1-2) region; wherein the A2 domain comprises an XTEN permissive loop-1 (A2-1) region and an XTEN permissive loop-2 (A2-2) region; wherein the A3 domain comprises an XTEN permissive loop-1 (A3-1) region and an XTEN permissive loop-2 (A3-2) region;

wherein an XTEN sequence is inserted into at least one of the regions A1-1, A1-2, A2-1, A2-2, A3-1, or A3-2; and wherein the recombinant factor VIII protein exhibits procoagulant activity. In one embodiment of the heterodimer, the first polypeptide and the second polypeptide form a single polypeptide chain comprising the formula (A1)-a1-(A2)-a2-[B]-[a3]-(A3)-(C1)-(C2). In one embodiment of the foregoing, "fused" means a peptidic bond.

In another embodiment of the CFXTEN composition, the invention provides a first recombinant factor VIII polypeptide of formula X:

(A1)-a1-(A2)-a2-[B]X and a second polypeptide comprising Formula XI:

a3-(A3)-(C1)-(C2)        XI wherein the first polypeptide and the second polypeptide are fused or exist as a heterodimer; wherein, A1 is an A1 domain of factor VIII; A2 is an A2 domain of factor VIII; [B] is a B domain of factor VIII, a fragment thereof, or is deleted; A3 is an A3 domain of factor VIII; C1 is a C1 domain of factor VIII; C2 is a C2 domain of factor VIII; a1, a2, and a3 are acidic spacer regions; wherein an XTEN sequence is inserted into a3; and wherein the recombinant factor VIII protein exhibits procoagulant activity. In one embodiment of the heterodimer, the first polypeptide and the second polypeptide form a single polypeptide chain comprising the formula (A1)-a1-(A2)-a2-[B]-[a3]-(A3)-(C1)-(C2). In one embodiment of the foregoing, "fused" means a peptidic bond.

In embodiments of the foregoing formulae X and XI polypeptides, the XTEN permissive loops are contained within surface-exposed, flexible loop structures, and wherein A1-1 is located between beta strand 1 and beta strand 2, A1-2 is located between beta strand 11 and beta strand 12, A2-1 is located between beta strand 22 and beta strand 23, A2-2 is located between beta strand 32 and beta strand 33, A3-1 is located between beta strand 38 and beta strand 39 and A3-2 is located between beta strand 45 and beta strand 46, according to the secondary structure of mature factor VIII stored as Accession Number 2R7E of the DSSP database. In other embodiments of the foregoing formulae X and XI polypeptides, the surface-exposed, flexible loop structure comprising A1-1 corresponds to a region in native mature human factor VIII from about amino acid 15 to about amino acid 45. In other embodiments of the foregoing formulae X and XI polypeptides the A1-1 corresponds to a region in native mature human factor VIII from about amino acid 18 to about amino acid 41. In other embodiments of the foregoing formulae X and XI polypeptides, the surface-exposed, flexible loop structure comprising A1-2 corresponds to a region in native mature human factor VIII from about amino acid 201 to about amino acid 232. In other embodiments of the foregoing formulae X and XI polypeptides the A1-2 corresponds to a region in native mature human factor VIII from about amino acid 218 to about amino acid 229. In other embodiments of the foregoing formulae X and XI polypeptides, the surface-exposed, flexible loop structure comprising A2-1 corresponds to a region in native mature human factor VIII from about amino acid 395 to about amino acid 421. In other embodiments of the foregoing formulae X and XI poly peptides, the A2-1 corresponds to a region in native mature human factor VIII from about amino acid 397 to about amino acid 418. In other embodiments of the foregoing formulae X and XI polypeptides, the surface-exposed, flexible loop structure comprising A2-2 corresponds to a region in native mature human factor VIII from about amino acid 577 to about amino acid 635. In other embodiments of the foregoing formulae X and XI polypeptides, the A2-2 corresponds to a region in native mature human factor VIII from about amino acid 595 to about amino acid 607. In other embodiments of the foregoing formulae X and XI polypeptides, the surface-exposed, flexible loop structure comprising A3-1 corresponds to a region in native mature human factor VIII from about amino acid 1705 to about amino acid 1732. In other embodiments of the foregoing formulae X and XI poly peptides, the A3-1 corresponds to a region in native mature human factor VIII from about amino acid 1711 to about amino acid 1725. In other embodiments of the foregoing formulae X and XI polypeptides, the surface-exposed, flexible loop structure comprising A3-2 corresponds to a region in native mature human factor VIII from about amino acid 1884 to about amino acid 1917. In other embodiments of the foregoing formulae X and XI polypeptides, the A3-2 corresponds to a region in native mature human factor VIII from about amino acid 1899 to about amino acid 1911. In other embodiments of the foregoing formulae X and XI polypeptides, an XTEN sequence is inserted into at least two of the regions A1-1, A1-2, A2-1, A2-2, A3-1, or A3-2. In other embodiments of the foregoing formulae X and XI polypeptides, an XTEN sequence is inserted immediately downstream of an amino acid which corresponds to an amino acid in mature native human factor VIII selected from the group consisting of amino acid residue number 32, 220, 224, 336, 339, 399, 416, 603, 1656, 1711, 1725, 1905 and 1910. In other embodiments of the foregoing formulae X and XI polypeptides, an additional XTEN sequence is inserted into the a3 acidic spacer region. In other embodiments of the foregoing formulae X and XI polypeptides, an additional XTEN sequence is inserted into the a3 acide spacer immediately downstream of an amino acid which corresponds to amino acid 1656. In other embodiments of the foregoing formulae X and XI polypeptides, the A1 domain comprises an XTEN permissive loop-1 (A1-1) region and an XTEN permissive loop-2 (A1-2) region wherein the A2 domain comprises an XTEN permissive loop-1 (A2-1) region and an XTEN permissive loop-2 (A2-2) region, and wherein the A3 domain comprises an XTEN permissive loop-1 (A3-1) region and an XTEN permissive loop-2 (A3-2) region, and wherein an additional XTEN sequence is inserted into at least one of the regions A1-1, A1-2, A2-1, A2-2, A3-1, or A3-2. In other embodiments of the foregoing formulae X and XI polypeptides, an additional XTEN sequence is inserted immediately downstream of an amino acid which corresponds to an amino acid in mature native human factor VIII selected from the group consisting of amino acid residue number 32, 220, 224, 336, 339, 390, 399, 416, 603, 1656, 1711, 1725, 1905 and 1910. In the foregoing embodiments of formulae X and XI polypeptides, the fusion protein exhibits at least about 30%, 40%, 50%, 60%, 70%, or 80%, or 90% of the procoagulant activity of the corresponding factor VIII not linked to XTEN, wherein the procoagulant activity is assayed by an in vitro coagulation assay.

In all embodiments, the polypeptide can, for example, exhibit an in vitro procoagulant activity exceeding 0.5 IU/ml, or 1.0, or 1.5, or 2.0 IU/ml when expressed in cell-culture medium and assayed by an in vitro coagulation assay. The procoagulant activity can be measured by a chromogenic assay, a one stage clotting assay (e.g., a aPTT) or both.

In some embodiments, wherein the recombinant factor VIII fusion protein comprises a factor VIII and at least a first and a second XTEN, the at least first XTEN is separated from the at least second XTEN by at least 10 amino acids, at least 50 amino acids, at least 100 amino acids, at least 200 amino acids, at least 300 amino acids, or at least 400 amino acids.

In preferred embodiments, the recombinant factor VIII fusion protein comprising a factor VIII and at least a first XTEN and, optionally, at least a second, or optionally at least a third, or optionally at least a fourth XTEN, the fusion protein exhibits reduced binding to an anti-factor VIII antibody as compared to the corresponding factor VIII not linked to XTEN. The reduced binding can be assessed either in vivo or by an in vitro assay. In one embodiment, the in vitro assay is an ELISA assay, wherein the binding of an anti-FVIII antibody to the fusion protein is reduced at least about 5%, 10%, 15%, 20%, 25%, 30%, 35% or at least about 40% or more compared to a FVIII not linked to XTEN. In another embodiment, the in vitro assay is a Bethesda assay wherein the reduced binding of the fusion protein is evidenced by a lower Bethesda titer of at least about 2, 4, 6, 8, 10, 12, 15, 20, 30, 40, 50, 60, 70, 80, 100, or 200 Bethesda units for the fusion protein compared to that for a factor VIII not linked to XTEN. In the in vitro assays, the anti-factor VIII antibody is selected from an antibody of Table 10 and polyclonal antibody from a hemophilia A patient with factor VIII inhibitors. In particular embodiments of a recombinant factor VIII fusion protein comprising a factor VIII and at least a first and a second XTEN exhibiting reduced binding to a factor VIII inhibitor antibody, the first XTEN is linked to said factor VIII polypeptide within a C2 domain of said factor VIII polypeptide, and the second XTEN is linked to said factor VIII polypeptide within an A1 or A2 domain of said factor VIII polypeptide, wherein said fusion protein exhibits reduced binding to a factor VIII inhibitor antibody as compared to the corresponding factor VIII not linked to XTEN, wherein the factor VIII inhibitor antibody is capable of binding to an epitope located within the A1, A2 or C2 domain, and further wherein the fusion protein exhibits procoagulant activity. In one embodiment of the foregoing fusion protein, the second XTEN is linked to said factor VIII polypeptide within the A2 domain of the factor VIII polypeptide and the factor VIII inhibitor antibody binds to the A2 domain of the factor VIII polypeptide. In another embodiment of the foregoing fusion protein, the second XTEN is linked to said factor VIII polypeptide within the C2 domain of the factor VIII polypeptide and the factor VIII inhibitor antibody binds to the C2 domain of the factor VIII polypeptide. The binding of an anti-factor VIII antibody to the fusion protein is reduced by at least about 5%, 10%, 5%, 20%, 25%, 30%, 35% or 40% compared to the corresponding factor VIII not linked to XTEN when assayed by an ELISA assay, wherein the anti-factor VIII antibody is selected from the group consisting of the antibodies in Table 10 and a polyclonal antibody from a hemophilia A subject with factor VIII inhibitors. The foregoing fusion proteins can further comprise at least three XTENs, wherein the at least third XTEN is linked to the factor VIII at a site selected from within or replacing the B domain, at the C-terminus, and at or within 1, 2, 3, 4, 5, or 6 amino acids of an insertion site selected from Table 7 or Table 9. In the embodiments with reduced binding to anti-factor VIII antibodies, the fusion protein has greater procoagulant activity in the presence of the anti-FVIII antibody of at least 10%, 20%, 30%, 40%, 50%, 80%, 100%, 200%, 300%, 400%, or 500% or more compared to a corresponding factor VIII not linked to XTEN when assayed by an in vitro coagulation assay (e.g., a chromogenic or one-stage clotting assay).

In all embodiments, the XTEN of the fusion protein can, for example, be characterized in that the XTEN comprise at least 36, or at least 42, or at least 72, or at least 96, or at least 144, or at least 288, or at least 400, or at least 500, or at least 576, or at least 600, or at least 700, or at least 800, or at least 864, or at least 900, or at least 1000, or at least 2000, to about 3000 amino acid residues or even more residues; the sum of glycine (G), alanine (A), serine (S), threonine (T), glutamate (E) and proline (P) residues constitutes at least about 80%, or at least about 90%, or at least about 95%, or at least about 96%, or at least about 97%, or at least about 98%, or at least about 99% of the total amino acid residues of the XTEN; the XTEN is substantially non-repetitive such that (i) the XTEN contains no three contiguous amino acids that are identical unless the amino acids are serine; (ii) at least about 80% of the XTEN sequence consists of non-overlapping sequence motifs, each of the sequence motifs comprising about 9 to about 14, or about 12 amino acid residues consisting of four to six amino acids selected from glycine (G), alanine (A), serine (S), threonine (T), glutamate (E) and proline (P), wherein any two contiguous amino acid residues do not occur more than twice in each of the non-overlapping sequence motifs; or (iii) the XTEN sequence has a subsequence score of less than 10; the XTEN has greater than 90%, or greater than 95%, or greater than 99% random coil formation as determined by GOR algorithm; the XTEN has less than 2% alpha helices and 2% beta-sheets as determined by Chou-Fasman algorithm; the XTEN lacks a predicted T-cell epitope when analyzed by TEPITOPE algorithm, wherein the TEPITOPE threshold score for said prediction by said algorithm has a threshold of −9, and wherein said fusion protein exhibits a terminal half-life that is longer than at least about 12 h, or at least about 24 h, or at least about 48 h, or at least about 72 h, or at least about 96 h, or at least about 120 h, or at least about 144 h, or at least about 21 days or greater. In one embodiment, the recombinant factor VIII fusion protein comprises at least a second, or at least a third, or at least a fourth XTEN, which can be identical or different to the other XTEN. According to a different approach, the at least one, at least a second, or at least a third, or at least a fourth XTEN of the CFXTEN fusion protein each have at least about 80% sequence identity, or about 90%, or about 91%, or about 92%, or about 93%, or about 94%, or about 95%, or about 96%, or about 97%, or about 98%, or about 99%, to about 100% sequence identity compared to one or more XTEN of comparable length selected from Table 4, Table 13, Table 14, Table 15, Table 16, and Table 17, when optimally aligned. In yet another different approach, the at least one, at least a second, or at least a third, or at least a fourth XTEN of the CFXTEN fusion protein each have at least 90%, or about 91%, or about 92%, or about 93%, or about 94%, or about 95%, or about 96%, or about 97%, or about 98%, or about 99%, to about 100% sequence identity compared to a sequence selected from AE42_1, AE42_2, AE42_3, AG42_1, AG42_2, AG42_3, AG42_4, AE144_1A, AE144_2A, AE144_2B, AE144_3A, AE144_3B, AE144_4A, AE144_4B, AE144_5A, AE144_6B, AG144_1, AG144_2, AG144_A, AG144_B, AG144_C, AG144_F, AG144_3, AG144_4, AE288_1, AE288_2, AG288_1, and AG288_2.

In one embodiment, the factor VIII component of the CFXTEN recombinant factor VIII fusion protein comprises one, two or three amino acid substitutions selected from residues R1648, Y1680, and R1689, numbered relative to mature human factor VIII, wherein the substitutions are selected from alanine, glycine, and phenylalanine. Non-limiting examples of said substitutions include R1648A, Y1680F, and R1689A.

In another embodiment, the CFXTEN fusion protein exhibits an apparent molecular weight factor of at least about 1.3, or at least about two, or at least about three, or at least about four, or at least about five, or at least about six, or at least about seven, or at least about eight, or at least about nine, or at least about 10, when measured by size exclusion chromatography or comparable method.

In some embodiments of the CFXTEN fusion proteins, one or more of the XTEN is to the FVIII via one or two cleavage sequences that each is cleavable by a mammalian protease selected from the group consisting of factor XIa, factor XIIa, kallikrein, factor VIIa, factor IXa, factor Xa, factor IIa (thrombin), Elastase-2, MMP-12, MMP13, MMP-17 and MMP-20, wherein cleavage at the cleavage sequence by the mammalian protease releases the factor VIII sequence from the XTEN sequence, and wherein the released factor VIII sequence exhibits an increase in procoagulant activity compared to the uncleaved fusion protein. In one embodiment, the cleavage sequence(s) are cleavable by factor XIa.

According to a different approach, the CFXTEN fusion proteins comprise at least three XTENs located at different locations of the factor VIII polypeptide, wherein said different locations are selected from: an insertion location at or within 1 to 6 amino acids from a site selected from Table 5, Table 6, Table 7 Table 8, and Table 9; a location at or within 1 to 6 amino acids of amino acid residue 32, 220, 224, 336, 339, 390, 399, 416, 603, 1656, 1711, 1725, 1905 and 1910 of mature factor VIII; a location between any two adjacent domains in the factor VIII sequence, wherein said two adjacent domains are selected from the group consisting of A1 and A2, A2 and B, B and A3, A3 and C1, and C1 and C2; a location within an internal B domain deletion starting from a first position at about amino acid residue number 741 to about 750 and ending at a second position at amino acid residue number 1635 to about 1648 with reference to full-length human factor VIII sequence as set forth in FIG. 3 and the C-terminus of the factor VIII sequence, wherein the cumulative length of the multiple XTENs is at least about 100 to about 3000 amino acid residues and wherein the fusion protein retains at least about 30%, or about 40%, or about 50%, or about 60%, or about 70%, or about 80%, or about 90% of the procoagulant activity compared to the corresponding factor VIII not linked to XTEN, wherein the procoagulant activity is assayed by an in vitro coagulation assay. In one embodiment of the foregoing, the fusion protein exhibits a prolonged terminal half-life when administered to a subject as compared to a corresponding factor VIII polypeptide lacking said XTEN, wherein said fusion protein exhibits a terminal half-life at least about 3 hours, or 4 hours, or 6 hours, or 12 hours, or 13 hours, or 14 hours, or 16 hours, or 24 hours, or 48 hours, or 72 hours, or 96 hours, or 120 hours, or 144 hours, or 7 days, or 14 days, or 21 days when administered to a subject. In one embodiment, the subject is selected from the group consisting of human and a factor VIII/von Willebrand factor double knock-out mouse. In one embodiment of the foregoing, the fusion protein does not comprise a sequence selected from GTPGS-GTASSSP (SEQ ID NO: 31), GSSTPSGATGSP (SEQ ID NO: 32), GSSPSASTGTGP (SEQ ID NO: 33), GASPGTSSTGSP (SEQ ID NO: 34), and GSEPATSGSET-PGTSESATPESGPGSEPATSGSETPGSPAGSPTSTEEGT-STEPSEGSAPGSEPATSG SETPGSEPATSGSETPGSE-PATSGSETPGTSTEPSEGSAPGTSESATPESGPGSEPA-TSGSETPGTST EPSEGSAP (SEQ ID NO: 59). In another embodiment of the foregoing, the fusion protein does not contain an XTEN sequence consisting of GSEPATSGSET-PGTSESATPESGPGSEPATSGSETPGSPAGSPTSTEEGT-STEPSEGSAPGSEPATSG SETPGSEPATSGSETPGSE-PATSGSETPGTSTEPSEGSAPGTSESATPESGPGSEPAT-SGSETPGTST EPSEGSAP (SEQ ID NO: 59), PGSSPSASTGTGPGSSPSASTGTGPGTPGSG-TASSSPGSSTPSGATGSPGSSPSASTGTGPGASPGTS STGSPGTPGSGTASSSPGSSTPSGATGSPGTPGSG-TASSSPGASPGTSSTGSPGASPGTSSTGSPGTP GSG-TASSS (SEQ ID NO: 71), or PGASPGTSSTGSP-GASPGTSSTGSPGTPGSGTASSSPGSSTPSGATGSP-GTPGSGTASSSPGSSTPSG ATGSPGTPGSGTASSSPGSSTPSGATGSPGSSTPS-GATGSPGSSPSASTGTGPGSSPSASTGTGPGA SPGTSSTGSPGTPGSGTASSSPGSSTPSGATG-SPGSSPSASTGTGPGSSPSASTGTGPGASPGTSSTG SPGASPGTSSTGSPGSSTPSGATGSPGSSPSASTGTGP-GASPGTSSTGSPGSSPSASTGTGPGTPGSG TASSSPGSSTPSGATGS (SEQ ID NO: 80).

In a further aspect, the invention concerns CFXTEN fusion proteins with enhanced pharmacokinetic properties, including enhanced parameters compared to FVIII not linked to XTEN, wherein the enhanced properties include but are not limited to longer terminal half-life, larger area under the curve, increased time in which the blood concentration remains within the therapeutic window, increased time between consecutive doses results in blood concentrations within the therapeutic window, and decreased dose in IU over time that can be administered compared to a FVIII not linked to XTEN, yet still result in a blood concentration above a threshold concentration needed for a procoagulant effect. In some embodiments, a CFXTEN fusion proteins exhibit a prolonged terminal half-life when administered to a subject as compared to a corresponding factor VIII polypeptide lacking said XTEN. The subject can be a human or a mouse, such as a factor VIII/von Willebrand factor double knock-out mouse. In one embodiment of the foregoing, the CFXTEN exhibits a terminal half-life that is at least about two-fold, or about three fold, or about four-fold, or about five-fold, or about 10-fold, or about 20-fold longer when administered to a subject compared to the corresponding factor VIII not linked to XTEN. In one embodiment, the CFXTEN fusion protein exhibits a terminal half-life at least about 3 hours, or 4 hours, or 6 hours, or 12 hours, or 13 hours, or 14 hours, or 16 hours, or 24 hours, or 48 hours, or 72 hours, or 96 hours, or 120 hours, or 144 hours, or 7 days, or 14 days, or 21 days when administered to the subject. In other embodiments, the enhanced pharmacokinetic property of the fusion proteins of the embodiments is the property of maintaining a circulating blood concentration of procoagulant fusion protein in a subject in need thereof above a threshold concentration of 0.01 IU/ml, or 0.05 IU/ml, or 0.1 IU/ml, or 0.2 IU/ml, or 0.3 IU/ml, or 0.4 IU/ml or 0.5 IU/ml for a period that is at least about two fold, or at least about three-fold, or at least about four-fold, or at least about five-fold, or at least about six-fold, or at least about eight-fold, or at least about ten-fold, or at least about 20-fold, or at least about 40-fold, or at least about 60-fold longer compared to the corresponding FVIII not linked to XTEN and administered to a subject at a comparable dose. The increase in half-life and time spent above the threshold concentration permits less frequent dosing and decreased amounts of the fusion protein (in moles equivalent) that are administered to a subject, compared to the corresponding FVIII not linked to XTEN. In one embodiment, administration of a subject fusion protein to a subject using a therapeutically-effective dose regimen results in a gain in time of at least two-fold, or at least three-fold, or at least four-fold, or at least five-fold, or at least six-fold, or at least eight-fold, or at least 10-fold, or at least about 20-fold, or at least about 40-fold, or at least about 60-fold or higher between at least two consecutive Cmax peaks and/or Cmin troughs for blood levels of the fusion protein compared to the corresponding FVIII not linked to the XTEN and administered using a comparable dose regimen to a subject.

In preferred embodiments, the CFXTEN fusion proteins retain at least about 30%, or about 40%, or about 50%, or about 60%, or about 70%, or about 80%, or about 90% of the procoagulant activity compared to the corresponding factor VIII not linked to XTEN, wherein the procoagulant activity is assayed by an in vitro coagulation assay such as, but not limited to a chromogenic assay or a one- or two-stage clotting assay.

According to a different approach, the invention provides recombinant factor VIII fusion proteins comprising a factor VIII polypeptide and at least one extended recombinant polypeptide (XTEN), wherein said factor VIII polypeptide comprises A1 domain, A2 domain, A3 domain, C1 domain, C2 domain and optionally all or a portion of B domain, and wherein said at least one XTEN is linked to said factor VIII polypeptide at an insertion site selected form residue numbers 18-32, or 40, or 211-224, or 336-403, or 599, or 745-1640, or 1656-1728, or 1796-1804, or 1900-1912, or 2171-2332; and wherein the fusion protein retains at least about 30%, or about 40%, or about 50%, or about 60%, or about 70%, or about 80%, or about 90% of the procoagulant activity compared to the corresponding factor VIII not linked to XTEN. In one embodiment of the foregoing, the fusion protein comprises at least a second XTEN, or at least a third, or at least a fourth XTEN wherein the XTEN are linked to the factor VIII at a site at or within 1 to 6 amino acids of a site selected from Table 5, Table 6, Table 7, Table 8, and Table 9. In another embodiment, the invention provides an recombinant factor VIII fusion protein further comprising at least a second XTEN, or at least a third, or at least a fourth XTEN linked to said FVIII polypeptide at an insertion site selected from Table 5, Table 6, Table 7, Table 8, Table 9, at or within 6 amino acids to the N- or C-terminus side of an insertion location at one or more insertion locations from FIG. 8 and within one or more insertion ranges from FIG. 9 wherein at least two XTEN are separated by an amino acid sequence of at least 100 to about 400 amino acids.

The invention provides CFXTEN wherein the XTEN have a Ratio XTEN Radii of at least 2.3 or at least 2.5, and are separated by an amino acid sequence of at least about 20 amino acid residues, or at least about 50, or at least about 100, or at least about 200, or at least about 300, or at least about 400 amino acid residues. In other embodiments, the CFXTEN comprise at least four XTEN wherein the XTEN have a Ratio XTEN Radii of at least 2.3, or at least 2.5, or at least 2.8, and wherein at least three of the four of the XTEN linked to the fusion protein are separated by an amino acid sequence of at least about 20 amino acid residues, or at least about 50, or at least about 100, or at least about 200, or at least about 300, or at least about 400 amino acid residues, and the fourth XTEN is linked within the B domain (or a fragment thereof) or within the C domain (or the terminus thereof).

In some embodiments, the subject compositions are configured to have reduced binding affinity for a clearance receptor in a subject as compared to the corresponding FVIII not linked to the XTEN. In one embodiment, the CFXTEN fusion protein exhibits binding affinity for a clearance receptor of the FVIII in the range of about 0.01%-30%, or about 0.1% to about 20%, or about 1% to about 15%, or about 2% to about 10% of the binding affinity of the corresponding FVIII not linked to the XTEN. In another embodiment, a fusion protein with reduced affinity for a clearance receptor has reduced active clearance and a corresponding increase in half-life of at least about 2-fold, or 3-fold, or at least 4-fold, or at least about 5-fold, or at least about 6-fold, or at least about 7-fold, or at least about 8-fold, or at least about 9-fold, or at least about 10-fold, or at least about 12-fold, or at least about 15-fold, or at least about 17-fold, or at least about 20-fold longer compared to the corresponding FVIII that is not linked to the XTEN.

In an embodiment, the invention provides a recombinant factor VIII fusion protein comprising FVIII and one or more XTEN wherein the fusion protein exhibits increased solubility of at least three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least 40-fold, or at least 60-fold at physiologic conditions compared to the FVIII not linked to XTEN.

In a further aspect, the invention provides a pharmaceutical composition comprising the fusion protein of any of the embodiments described herein and a pharmaceutically acceptable carrier.

In another embodiment, the invention provides a method of treating a coagulopathy in a subject, comprising administering to said subject a composition comprising a clotting effective amount of the pharmaceutical composition. In one embodiment of the method, after said administration, a blood concentration of procoagulant factor VIII is maintained at about 0.05, or 1, or 1.5 IU/ml or more for at least 48 hours after said administration. In another embodiment, the invention provides a method of clotting blood in a subject, comprising contacting a clotting effective amount of the pharmaceutical composition with the blood.

In another embodiment, the invention provides a method of treating a coagulopathy in a subject with circulating inhibitors of factor VIII, comprising administering to said subject a composition comprising a therapeutically effective amount of the pharmaceutical composition of CFXTEN, wherein the composition exhibits greater procoagulant activity in said subject compared to a composition comprising the corresponding factor VIII not linked to XTEN and administered using a comparable amount. In one embodiment of the method, the coagulopathy is hemophilia A. In another embodiment, the coagulopathy is the result of trauma or surgery or infection.

The invention provides a method of treating a bleeding episode in a subject, comprising administering to said subject a composition comprising a clotting effective amount of the CFXTEN pharmaceutical composition, wherein the clotting effective amount of the fusion protein arrests a bleeding episode for a period that is at least three-fold, or at least four-fold, or at least five-fold longer compared to a corresponding factor VIII not linked to XTEN and administered using a comparable amount to said subject. Non-limiting examples of a corresponding factor VIII not linked to XTEN include native FVIII, the sequences of Table 1, BDD-FVIII, and the pCB0114 FVIII.

In another embodiment, the invention provides a CFXTEN recombinant factor VIII fusion protein for use in a pharmaceutical regimen for treating a hemophilia A patient, said regimen comprising a pharmaceutical composition comprising a CFXTEN fusion protein. In one embodiment of the pharmaceutical regimen, the regimen further comprises the step of determining the amount of pharmaceutical composition comprising the CFXTEN needed to achieve hemostasis in the hemophilia A patient. In another embodiment, the pharmaceutical regimen for treating a hemophilia A subject comprises administering the pharmaceutical composition in two or more successive doses to the subject at an effective amount, wherein the administration results in at least a 10%, or 20%, or 30%, or 40%, or 50%, or 60%, or 70%, or 80%, or 90% greater improvement of at least one, two, or three parameters associated with the hemophilia A disease compared to the factor VIII not linked to XTEN and administered using a comparable dose. Non-limited examples of parameters improved include blood concentration of procoagulant FVIII, a reduced activated partial prothrombin (aPTT) assay time, a reduced one-stage or two-stage clotting assay time, delayed onset of a bleeding episode, a reduced chromogenic assay time, a reduced bleeding assay time, resolution of a bleeding event, or a reduced Bethesda titer to native FVIII.

In another aspect, the invention provides isolated nucleic acid sequences encoding the fusion proteins of any one of the embodiments of the CFXTEN fusion protein. In one embodiment, the isolated nucleic acid is the complement of a sequence encoding a CFXTEN fusion protein of the embodiments. In one embodiment, the isolated nucleic acid further comprises a sequence encoding a signal peptide, wherein said sequence is ATGCAAATAGAGCTCTCCAC-CTGCTTCTTTCTGTGCCTTTTGCGATTCTGCTTTAGT (SEQ ID NO: 1613), or the complement thereof. In another embodiment, the invention provides an expression vector comprising the nucleic acid encoding the fusion protein, or the complement thereof. In another embodiment, the invention provides an isolated host cell comprising the foregoing expression vector. In another embodiment, the invention provides a method of producing the fusion protein of any of the embodiments, comprising providing a host cell comprising the expression vector; culturing the host cell to effect production of the fusion protein; and recovering the fusion protein.

In one embodiment, the invention provides an isolated fusion protein comprising a polypeptide having at least about 80% sequence identity, or about 90%, or about 91%, or about 92%, or about 93%, or about 94%, or about 95%, or about 96%, or about 97%, or about 98%, or about 99%, to about 100% sequence identity compared to a sequence of comparable length selected from Table 21, when optimally aligned.

In another embodiment, the invention provides an isolated nucleic acid comprising a polynucleotide sequence selected from (a) a sequence having at least about 80% sequence identity, or about 90%, or about 91%, or about 92%, or about 93%, or about 94%, or about 95%, or about 96%, or about 97%, or about 98%, or about 99%, to about 100% sequence identity compared to a sequence of comparable length selected from Table 21, when optimally aligned, or (b) the complement of the polynucleotide of (a). In another embodiment, the isolated nucleic acid comprises the sequence ATGCAAATAGAGCTCTCCACCTGCTTCTTTCTGT-GCCTTTTGCGATTCTGCTTTAGT (SEQ ID NO: 1613) linked to the 5' end of the nucleic acid of (a) or the complement of the sequence linked to the 3' end of (b).

It is specifically contemplated that the recombinant factor VIII fusion proteins can exhibit one or more or any combination of the properties disclosed herein.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 1 shows a schematic representation of the FVIII architecture and spatial arrangement of the domains during processing and clotting, and is intended to represent both native FVIII and B domain deleted variants. The A1 domain ranges from residue 1 to 372 (numbering relative to the mature form of FVIII sequence NCBI Protein RefSeq NP_000123 and encompassing a1 residues), A2 domain ranges from residue 373 to 740, B domain ranges from residue 741 to 1648, A3 domain ranges from residue 1649 to 2019 (encompassing a3 acidic region), C1 domain ranges from 2020 to 2172, and the C2 domain ranges from residue 2173 to 2332. BDD variants include deletions between the range 741 to 1648, leaving some or no remnant residues, with a non-limiting BDD remnant sequence being SFSQN-PPVLKRHQR (SEQ ID NO: 1614). FIG. 1A shows the domain architecture of a single chain FVIII prior to processing. Arrows indicate the sites at residues R372, R740, R1648, and R1689 that are cleaved in the processing and conversion of FVIII to FVIIIa. FIG. 1B shows the FVIII molecule that has been processed into the heterodimer by the cleavage at the R1648 residue, with the a3 acidic region of the A3 domain indicated on the N-terminus of the A3. FIG. 1C shows the FVIII molecule processed into the FVIIIa heterotrimer by the cleavage at the R372, R740, and R1689 residues.

FIG. 3 depicts the amino acid sequence of mature human factor V111 (SEQ ID NO: 1592).

FIG. 4 depicts a factor VIII sequence with a deletion of a portion of the B domain (SEQ ID NO: 1593).

FIG. 5A shows, left to right, three variations of single chain factor VIII with XTEN linked to the N-terminus, the C-terminus, and two XTEN linked to the N- and C-terminus. FIG. 5B shows six variations of mature heterodimer FVIII with, left to right, an XTEN linked to the N-terminus of the A1 domain; an XTEN linked to the C-terminus of the C2 domain; an XTEN linked to the N-terminus of the A1 domain and the C-terminus of the C2 domain; an XTEN linked to the N-terminus of the A1 domain and to the N-terminus of the A3 domain; an XTEN linked to the C-terminus of the C2 domain and to the N-terminus of the A3 domain via residual B domain amino acids; and an XTEN linked to the N-terminus of the A1 domain, the C-terminus of the A2 domain via residual B domain amino acids, and to the C-terminus of the C2 domain. FIG. 5C shows, left to right, three variations of single chain factor VIII: an XTEN linked to the N-terminus of the A1 domain, an XTEN linked within a surface loop of the A1 domain and an XTEN linked within a surface loop of the A3 domain; an XTEN linked within a surface loop of the A2 domain, an XTEN linked within a surface loop of the C2 domain and an XTEN linked to the C terminus of the C2 domain; an XTEN linked to the N-terminus of the A1 domain and within a surface loop of the C1 domain and to the C-terminus of the C domain. FIG. 5D shows six variations of mature heterodimer FVIII with, left to right, an XTEN linked to the N-terminus of the A1 domain, an XTEN linked within a surface loop of the A1 domain, and an XTEN linked within a surface loop of the A3 domain; an XTEN linked within a surface loop of the A2 domain, and an XTEN linked within a surface loop of the C1 domain, and an XTEN linked to the C-terminus of the C2 domain; an XTEN linked to the N-terminus of the A1 domain, an XTEN linked within a surface loop of the A1 domain, an XTEN linked within a surface loop of the A3 domain, and an XTEN linked to the C-terminus of the C2 domain; an XTEN linked to the N-terminus of the A1 domain, an XTEN linked to the N-terminus of the A3 domain via residual amino acids of the B domain, and an XTEN linked within a surface loop of the C2 domain; an XTEN linked within a surface loop of the A2 domain, an XTEN linked to the N-terminus of the A3 domain via residual amino acids of the B domain, an XTEN linked within a surface loop of the C1 domain, and an XTEN linked to the C-terminus of the C2 domain; and an XTEN linked within the B domain or between the residual B domain residues of the BDD variant (and the invention also contemplates a variation in which the XTEN replaces the entirety of the B domain, including all native cleavage sites, linking the A2 and A3 domains, resulting in a single chain form of factor VIII). This figure also embodies all variations in which one or more XTEN sequences are inserted within the B domain and the resulting fusions are cleaved at one or more sites (e.g., at R1648 site) during intracellular processing.

FIG. 6 is a graphic portrayal of a CFXTEN construct with an XTEN inserted within the B domain and linked to the C-terminus of the C2 domain illustrating the unstructured characteristic of the XTEN leading to random coil formation that can cover portions of the factor VIII proximal to the XTEN. In the lower panel, the drawing depicts that when XTEN is in random coil, it can adopt a conformation resulting in steric hindrance that blocks binding of factor VIII inhibitor antibodies that would otherwise have affinity for epitopes proximal to the XTEN site of insertion.

FIG. 16 illustrates the use of donor XTEN sequences to produce truncated XTENs. FIG. 16A provides the sequence of AG864 (SEQ ID NO: 1596), with the underlined sequence used to generate a sequence length of 576 (SEQ ID NO: 1597). FIG. 16B provides the sequence of AG864 (SEQ ID NO: 1598), with the underlined sequence used to generate a sequence length of 288 (SEQ ID NO: 1599). FIG. 16C provides the sequence of AG864 (SEQ ID NO: 1600), with the underlined sequence used to generate a sequence length of 144 (SEQ ID NO: 1601). FIG. 16D provides the sequence of AE864 (SEQ ID NO: 1602), with the underlined sequence used to generate a sequence length of 576 (SEQ ID NO: 1603). FIG. 16E provides the sequence of AE864 (SEQ ID NO: 1604), with the underlined sequence used to generate a sequence length of 288 (SEQ ID NO: 1605). FIG. 16F provides the sequence of AE864 (SEQ ID NO: 1606) used to generate four sequences of 144 length (SEQ ID NOS 1607-1610, respectively, in order of appearance) (the double underline indicates the first amino acid in the 144 sequence with the single underline representing the balance of that sequence).

FIG. 17 is a schematic representation of the design of Factor VIII-XTEN expression vectors with different strategies introducing XTEN elements into the FVIII coding sequence. FIG. 17A shows an expression vector encoding XTEN fused to the 3' end of the sequence encoding FVIII. FIG. 17B depicts an expression vector encoding an XTEN element inserted into the middle of the coding sequence encoding a single FVIII. FIG. 17C depicts an expression vector encoding two XTEN elements: one inserted internal to the FVIII coding sequence, and the other fused to the 3' end of the FVIII coding sequence.

FIG. 24 is a graphic and tabular portrayal of the pharmacokinetic properties of rBDD-FVIII and the purified CFXTEN fusion proteins pBC0145 and pBC0146 (with C-terminal XTEN) administered to either HemA or FVIII/VWF double knock-out mice as described in Example 30, showing the enhanced half-life of the CFXTEN in both strains of mice.

FIG. 25 is a graphic and tabular portrayal of the pharmacokinetic properties of rBDD-FVIII and the CFXTEN fusion proteins pSD0050 and pSD0062 (with internal inserted XTEN) administered to either HemA (FIG. 25A) or FVIII/VWF double knock-out mice (FIG. 25B) using a cell culture PK assay in HemA mice. Dose, 5-minute recovery, and half-life (T1/2) are shown, as described in Example 32, underscoring the enhanced recovery and half-life of the CFXTEN compared to the positive control FVIII in both strains of mice.

FIG. 37 shows a ClustalW multiple sequence alignment of domains A1, A2, A3, C1 and C2 of FVIII showing the location of XTEN insertions resulting in recombinant FVIII proteins displaying FVIII activity (black box, white text) or displaying no FVIII activity (grey box, bold text).

FIG. 38 shows a DSSP graphical representation of the secondary structure of the two polypeptide chains in a native active human FVIII crystal structure deposited under the identifier 2R7E at the Protein Data Bank (see Example 47). Amino acid sequence numbering is the same as in the protein sequence in FIG. 30. The beta sheet regions are shown as filled arrows and are designated 31 to P66. The location of the XTEN permissive loops is denoted by crosshatched boxes. Domain A1 XTEN permissive loops are designated Loop A1-1 and Loop A1-2. Domain A2 XTEN permissive loops are designated Loop A2-1 and Loop A2-2. Domain A3 XTEN permissive loops are designated Loop A3-1 and Loop A3-2.

FIG. 39 shows a DSSP graphical representation of the secondary structure of the two polypeptide chains in a native active human FVIII crystal structure deposited under the identifier 2R7E at the Protein Data Bank (see Example 47). Amino acid sequence numbering is the same as in the protein sequence in FIG. 30. The beta sheet regions are shown as filled arrows and are designated 31 to P66. The location of the XTEN permissive loops is denoted by crosshatched boxes. Domain A1 XTEN permissive loops are designated Loop A1-1 and Loop A1-2. Domain A2 XTEN permissive loops are designated Loop A2-1 and Loop A2-2. Domain A3 XTEN permissive loops are designated Loop A3-1 and Loop A3-2.

FIG. 40 shows a ClustalW multiple sequence alignment of domains A1, A2, A3, C1 and C2 of FVIII showing the location of XTEN insertions resulting in recombinant FVIII proteins displaying FVIII activity (black box, white text) or displaying no FVIII activity (grey box, bold text). The locations of the XTEN permissive loops are indicated by dashed rectangles (see Example 47).

FIG. 41. FIG. 41A presents a front view structural representation of human FVIII (PDB:2R7E) showing the location of domains A1, A2, A3, C1 and C2 (circled in dashed lined) and the locations of XTEN permissive loops A1-1, A1-2, A2-1, A2-2, A3-1 and A3-2 highlighted as CPK sphere representations. FIG. 41B presents a side view structural representation of human FVIII (PDB:2R7E) showing the location of domains A1, A2, A3, C1 and C2 (circled in dashed lined) and the locations of XTEN permissive loops A1-1, A1-2, A2-1, A2-2, A3-1 and A3-2 highlighted as CPK sphere representations.

FIGS. 42A, 42C, and 42E show the top view structural representations of isolated human FVIII (PDB:2R7E) A domains showing the location of XTEN permissive loops highlighted as CPK sphere representations. FIGS. 42B, 42D and 42F show side view structural representations of isolated human FVIII (PDB:2R7E) A domains showing the location of XTEN permissive loops highlighted as CPK sphere representations.

Figure 43:
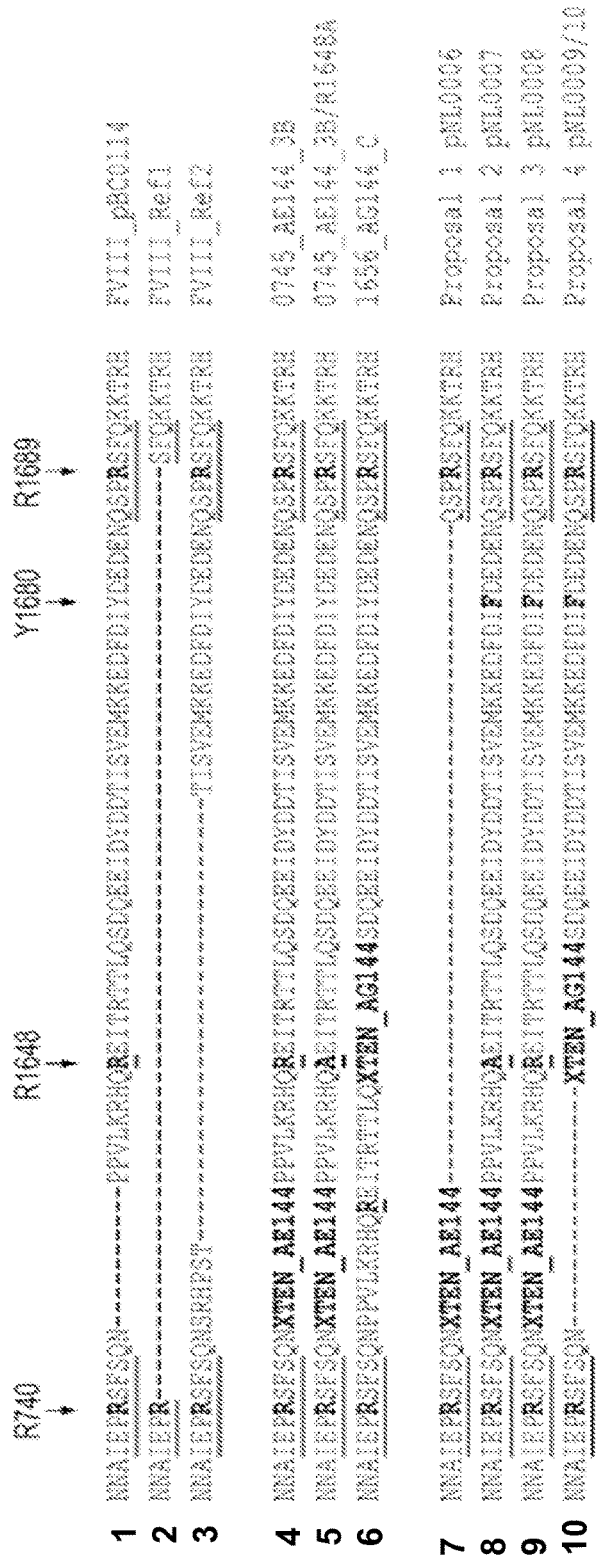

FIG. 43 shows sequences of various factor VIII B-domain deletions and individual mutations. Lines 4-10 show various B-domain deletions with indicated XTEN linking the flanking B-domain residual or A3 domain residues. The R1648A mutation is indicated by arrow in line 5 and 8, while the Y1680F mutation is indicated by arrow in lines 8-10.

Figure 44:
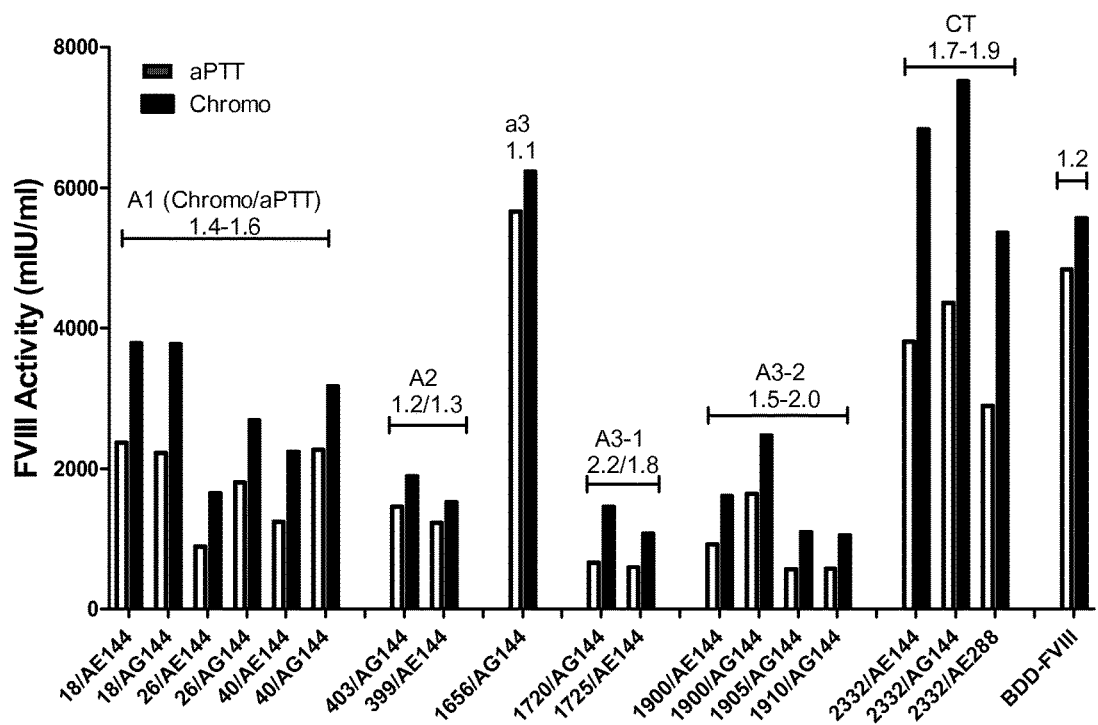

FIG. 44 is a bar graph of chromogenic and aPTT assay activity of various CFXTEN with single XTEN insertions (Example 49).

Figure 45:
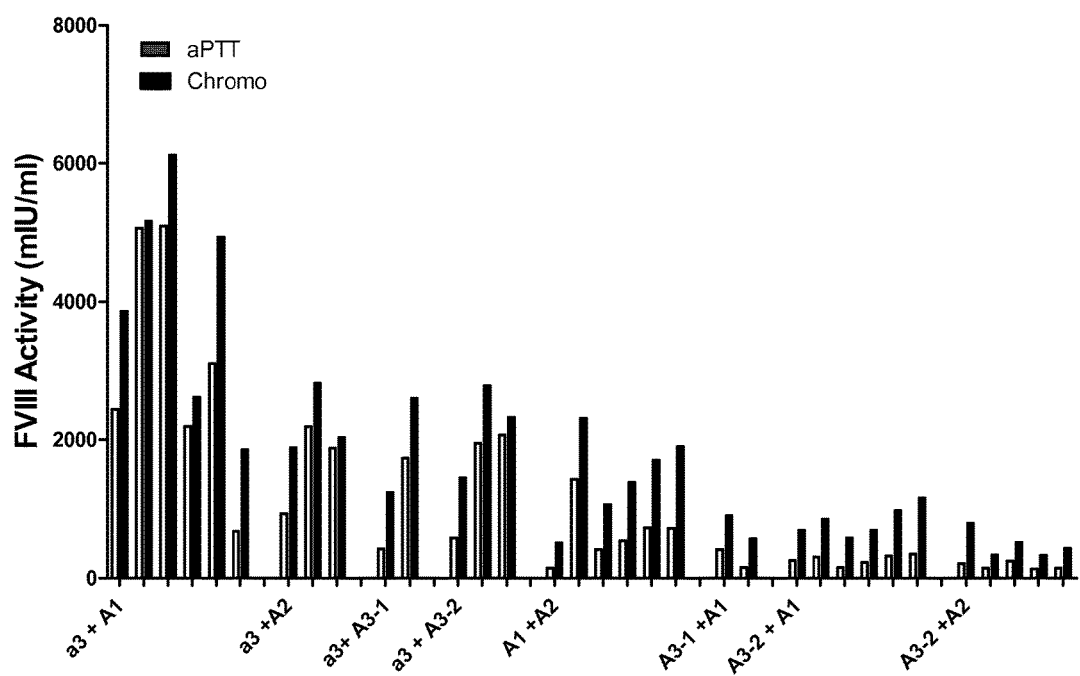

FIG. 45 is a bar graph of chromogenic and aPTT assay activity of various CFXTEN with 2 XTEN insertions (Example 49).

Figure 46:
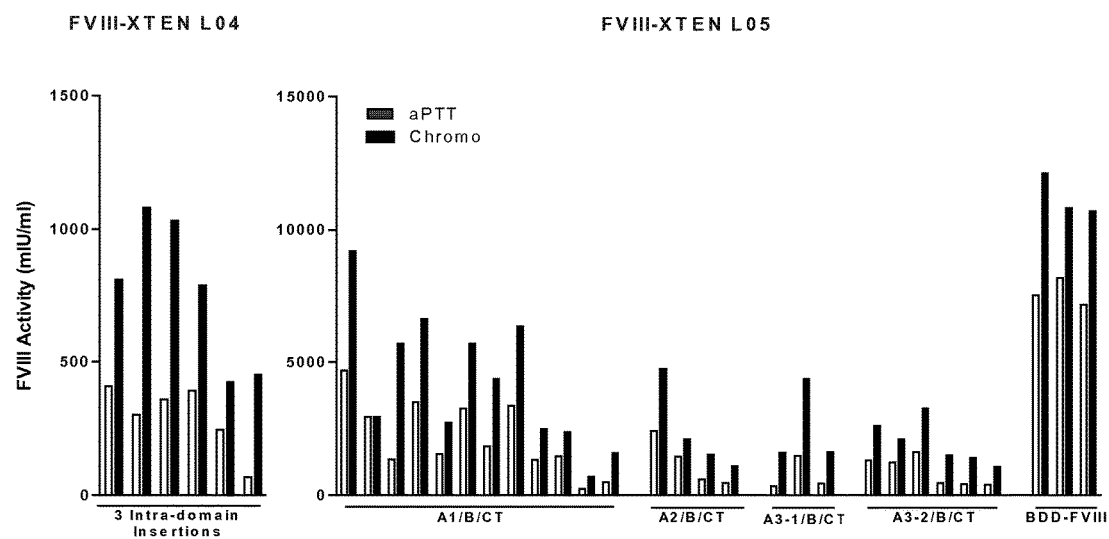

FIG. 46 is a bar graph of chromogenic and aPTT assay activity of various CFXTEN with 3 XTEN insertions (Example 49).

Figure 47:
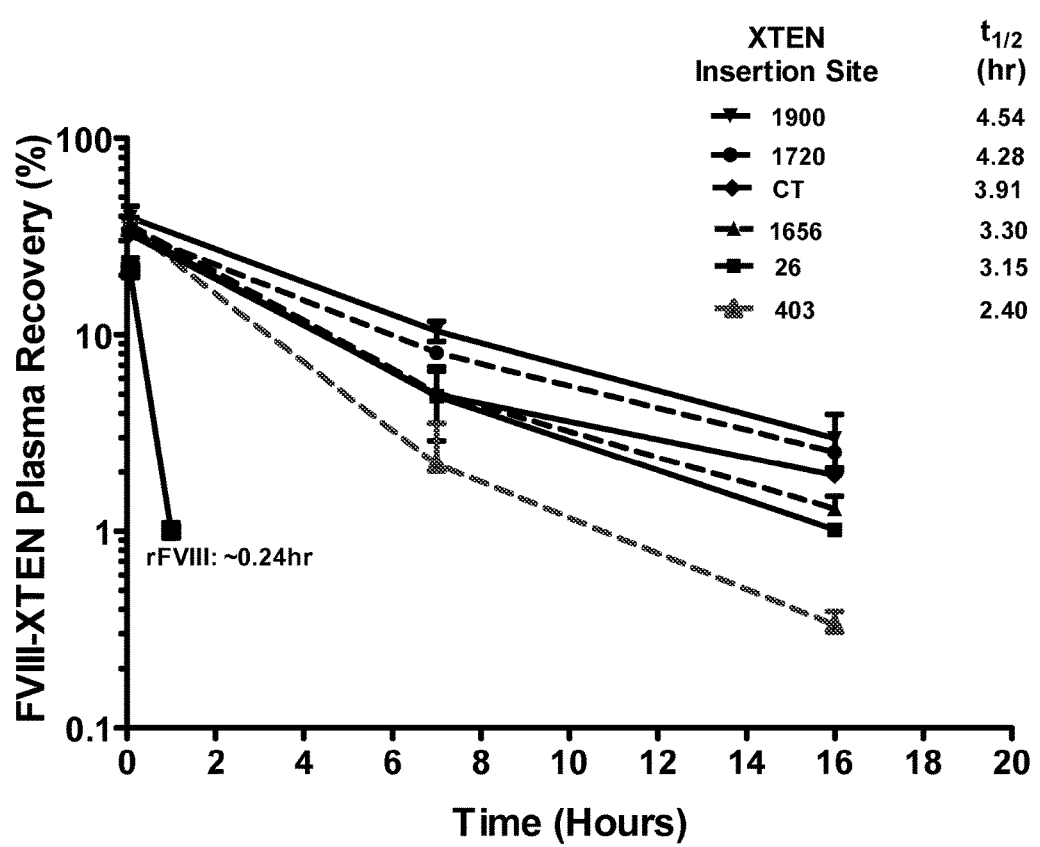

FIG. 47 is a graph of plasma levels in DKO mice of various administered CFXTEN with single XTEN insertions compared to a BDD-FVIII control, demonstrating the 10- to 20-fold longer half-life achieved by the XTEN insertions at various locations (Example 50).

Figure 48:
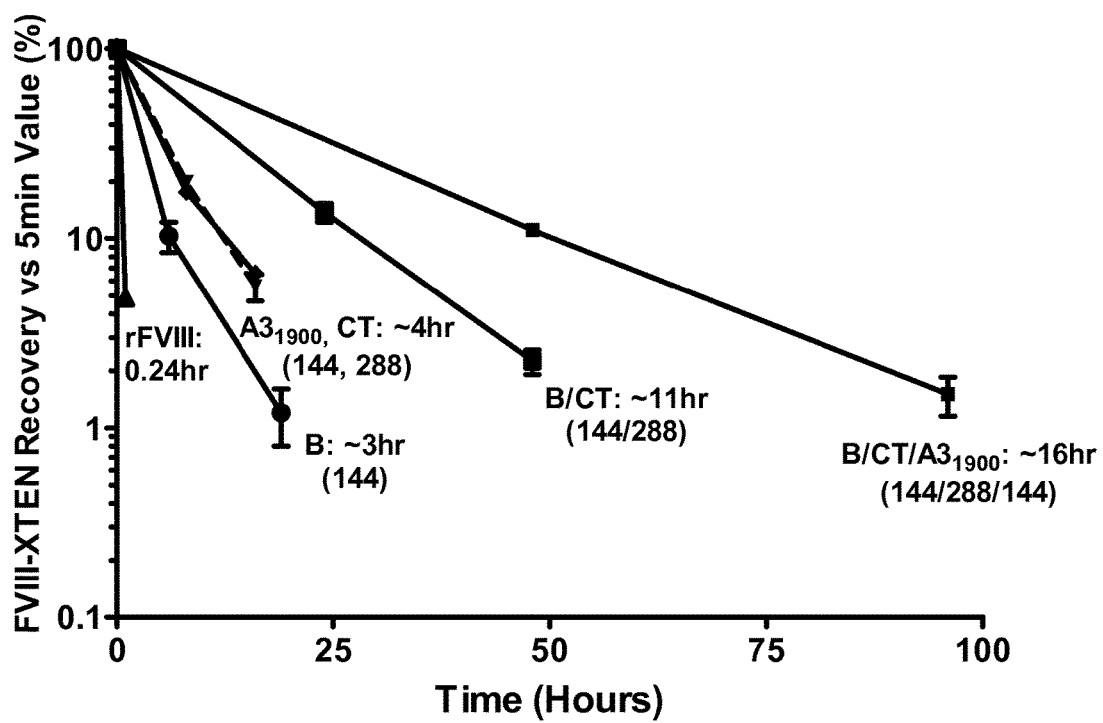

FIG. 48 is a graph of plasma levels in DKO mice of various administered CFXTEN with one, two, and three XTEN insertions compared to a BDD-FVIII control, demonstrating the increases in half-life achieved by the inclusion of additional XTEN insertions compared to single or two insertions (Example 51).

Figure 49:
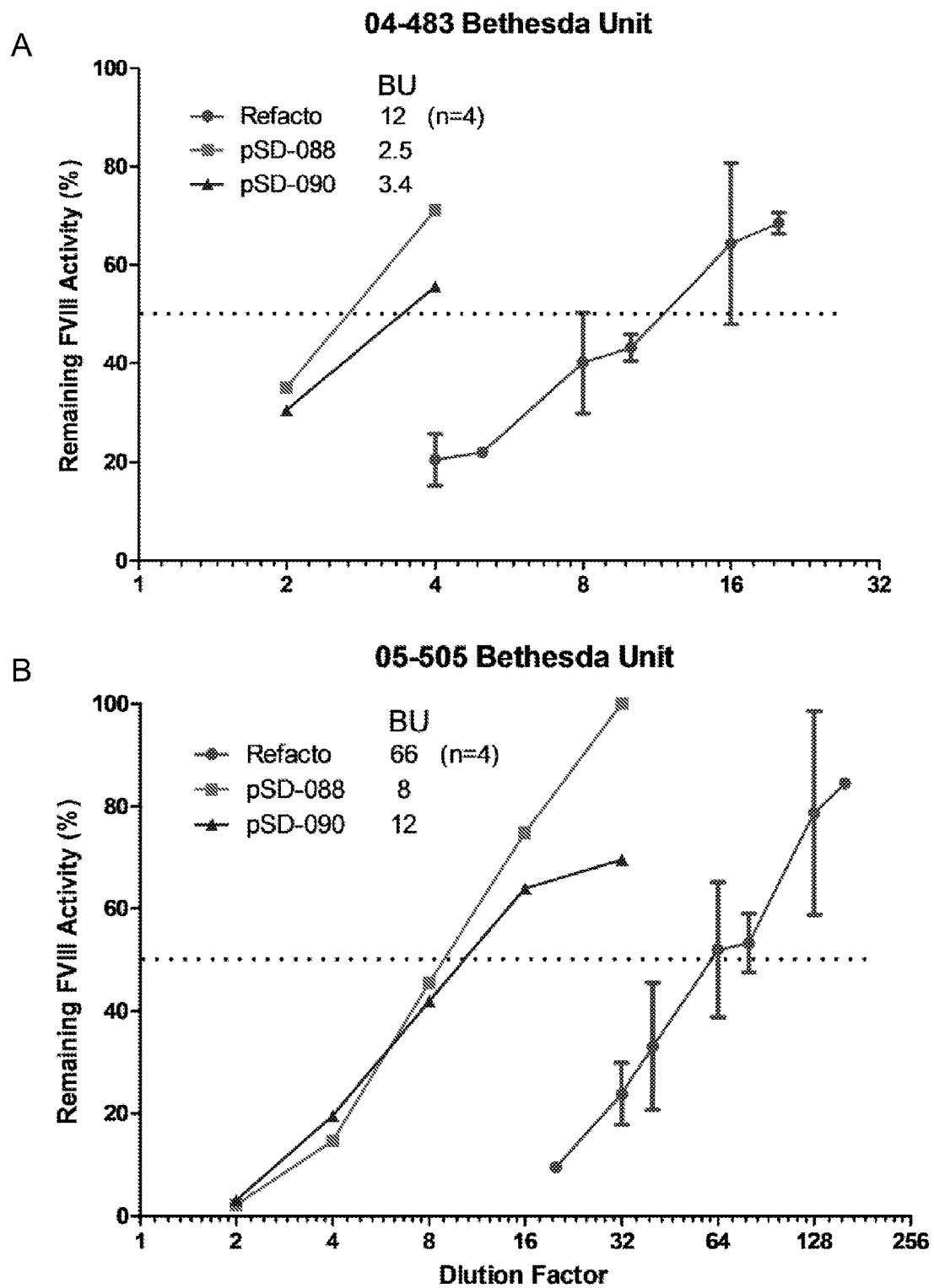
Figure 49:
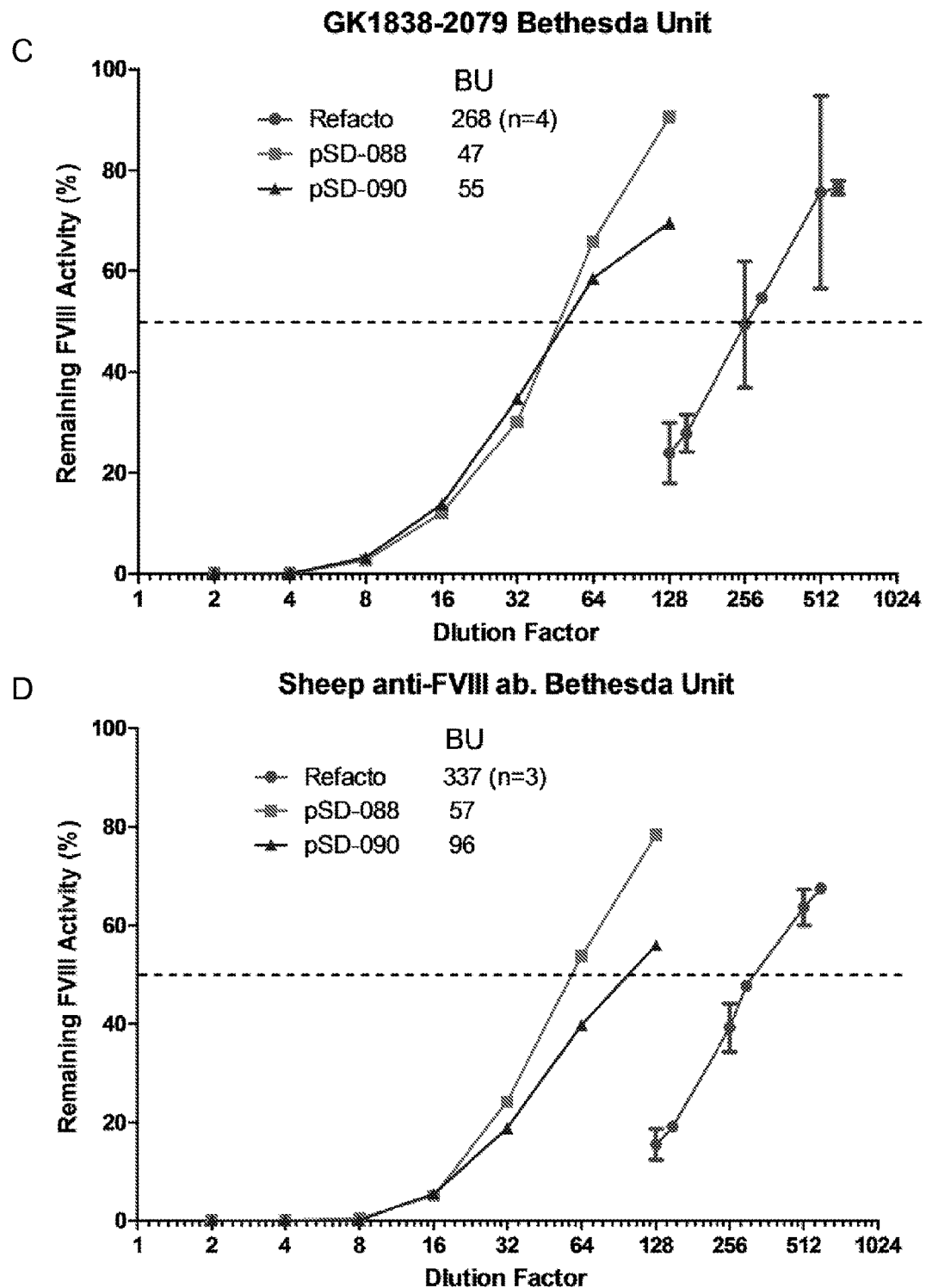

FIG. 49 are graphs of the plotted inhibition curves for remaining factor VIII procoagulant activity in samples assayed in the Bethesda assay with three hemophilia patient sera (FIGS. 49A-C) or sheep anti-FVII (FIG. 49D) described in Example 52, demonstrating a clear left-shift of the inhibition curve for the two CFXTEN molecules compared to the FVIII not linked to XTEN.

DETAILED DESCRIPTION OF THE INVENTION

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

In the context of the present application, the following terms have the meanings ascribed to them unless specified otherwise:

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein, the term "amino acid" refers to either natural and/or unnatural or synthetic amino acids, including but not limited to both the D or L optical isomers, and amino acid analogs and peptidomimetics. Standard single or three letter codes are used to designate amino acids.

The term "domain," when used in reference to a factor VIII polypeptide refers to either a full length domain or a functional fragment thereof, for example, full length or functional fragments of the A1 domain, A2 domain, A3 domain, B domain, C1 domain, and/or C2 domain of factor VIII.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" when applied to a protein, is a truncated form of a native biologically active protein that retains at least a portion of the therapeutic and/or biological activity. A "variant". when applied to a protein is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity compared with the reference biologically active protein. As used herein, the term "biologically active protein moiety" includes proteins modified deliberately, as for example, by site directed mutagenesis, synthesis of the encoding gene, insertions, or accidentally through mutations.

The term "sequence variant" means polypeptides that have been modified compared to their native or original sequence by one or more amino acid insertions, deletions, or substitutions. Insertions may be located at either or both termini of the protein, and/or may be positioned within internal regions of the amino acid sequence. A non-limiting example is insertion of an XTEN sequence within the sequence of the biologically-active payload protein. In deletion variants, one or more amino acid residues in a polypeptide as described herein are removed. Deletion variants, therefore, include all fragments of a payload polypeptide sequence. In substitution variants, one or more amino acid residues of a polypeptide are removed and replaced with alternative residues. In one aspect, the substitutions are conservative in nature and conservative substitutions of this type are well known in the art.

As used herein, "internal XTEN" refers to XTEN sequences that have been inserted into the sequence of the coagulation factor. Internal XTENs can be constructed by insertion of an XTEN sequence into the sequence of a coagulation factor such as FVIII, either by insertion between two adjacent amino acids within a domain ("intradomain") or between two domains ("interdomain") of the coagulation factor or wherein XTEN replaces a partial, internal sequence of the coagulation factor.

As used herein, "terminal XTEN" refers to XTEN sequences that have been fused to or in the N- or C-terminus of the coagulation factor or to a proteolytic cleavage sequence or linker at the N- or C-terminus of the coagulation factor. Terminal XTENs can be fused to the native termini of the coagulation factor. Alternatively, terminal XTENs can replace a portion of a terminal sequence of the coagulation factor.

The term "XTEN release site" refers to a cleavage sequence in CFXTEN fusion proteins that can be recognized and cleaved by a mammalian protease, effecting release of an XTEN or a portion of an XTEN from the CFXTEN fusion protein. As used herein, "mammalian protease" means a protease that normally exists in the body fluids, cells or tissues of a mammal. XTEN release sites can be engineered to be cleaved by various mammalian proteases (a.k.a. "XTEN release proteases") such as FXIa, FXIIa, kallikrein, FVIIIa, FVIIIa, FXa, FIIa (thrombin), Elastase-2, MMP-12, MMP13, MMP-17, MMP-20, or any protease that is present during a clotting event. Other equivalent proteases (endogenous or exogenous) that are capable of recognizing a defined cleavage site can be utilized. The cleavage sites can be adjusted and tailored to the protease utilized.

The term "within", when referring to a first polypeptide being linked to a second polypeptide, encompasses linking that connects the N-terminus of the first or second polypeptide to the C-terminus of the second or first polypeptide, respectively, as well as insertion of the first polypeptide into the sequence of the second polypeptide. For example, when an XTEN is linked "within" a domain of a factor VIII polypeptide, the XTEN may be linked to the N-terminus, the C-terminus, or may be inserted in said domain.

As used herein, the term "site," when used to refer to an insertion site of an XTEN within or to a biological polypeptide such as a factor VIII, represents the amino acid position at which the XTEN is linked. When numbered sites are described, such as a first, second, third, fourth, fifth, or sixth site for the insertion of an XTEN within or to the factor VIII, each site will be understood to represent a distinct site in the factor VIII; e.g., the second site is a different factor VIII location from the first site, the third site is different from the second and the first, etc.

"Activity" or "procoagulant activity" as applied to form(s) of a CFXTEN polypeptide provided herein, refers to the ability to bind to a target coagulation protein substrate or cofactor and promote a clotting event, whether measured by an in vitro, ex vivo or in vivo assay. Such assays include, but are not limited to, one-stage clotting assays, two-stage clotting assays, chromogenic assays, and ELISA assays. "Biological activity" refers to an in vitro or in vivo biological function or effect, including but not limited to either receptor or ligand binding, or an effect on coagulation generally known in the art for the FVIII coagulation factor, or a cellular, physiologic, or clinical response, including arrest of a bleeding episode.

As used herein, the term "ELISA" refers to an enzyme-linked immunosorbent assay as described herein or as otherwise known in the art.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated" when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising at least one region in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated", "linked," "fused," and "fusion" are used interchangeably herein. These terms refer to the joining together of two or more chemical elements, sequences or components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two or more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed as a recombinant protein in a host cell.

The terms "gene" and "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" or "sequence identity" refers to sequence similarity or interchangeability between two or more polynucleotide sequences or between two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity compared to those sequences. Polypeptides that are homologous preferably have sequence identities that are at least 70%, preferably at least 80%, even more preferably at least 90%, even more preferably at least 95-99%, and most preferably 100% identical.

"Ligation" refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al., "Molecular Cloning: A Laboratory Manual," 3$^{rd}$ edition, Cold Spring Harbor Laboratory Press, 2001. Typically, blocking reagents are used to block non-specific hybridization. Such blocking reagents include, for instance, sheared and denatured salmon sperm DNA at about 100-200 μg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity," percentage of sequence identity," and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured. The percentage of sequence identity is calculated by comparing two optimally aligned sequences over the window of comparison, determining the number of matched positions (at which identical residues occur in both polypeptide sequences), dividing the number of matched positions by the total number of positions in the window of comparison (i.e., the window size), and multiplying the result by 100 to yield the percentage of sequence identity. When sequences of different length are to be compared, the shortest sequence defines the length of the window of comparison. Conservative substitutions are not considered when calculating sequence identity.

"Percent (%) sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there is no a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Active clearance" means the mechanisms by which a protein is removed from the circulation other than by filtration or coagulation, and which includes removal from the circulation mediated by cells, receptors, metabolism, or degradation of the protein.

"Apparent molecular weight factor" and "apparent molecular weight" are related terms referring to a measure of the relative increase or decrease in apparent molecular weight exhibited by a particular amino acid sequence. The apparent molecular weight is determined using size exclusion chromatography (SEC) or similar methods by comparing to globular protein standards, and is measured in "apparent kD" units. The apparent molecular weight factor is the ratio between the apparent molecular weight and the actual molecular weight; the latter predicted by adding, based on amino acid composition, the calculated molecular weight of each type of amino acid in the composition or by estimation from comparison to molecular weight standards in an SDS electrophoresis gel.

The terms "hydrodynamic radius" or "Stokes radius" is the effective radius ($R_h$ in nm) of a molecule in a solution measured by assuming that it is a body moving through the solution and resisted by the solution's viscosity. In the embodiments of the invention, the hydrodynamic radius measurements of the XTEN fusion proteins correlate with the 'apparent molecular weight factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refers to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (2001). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Non-limiting examples for activation are the reaction of a carboxyl group with carbodiimide, the conversion of a carboxyl group into an activated ester, or the conversion of a carboxyl group into an azide function.

"Controlled release agent", "slow release agent", "depot formulation" and "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" and "immunogen" are used interchangeably herein to refer to the structure or binding determinant that an antibody fragment or an antibody fragment-based therapeutic binds to or has specificity against.

The term "payload" as used herein refers to a protein or peptide sequence that has biological or therapeutic activity; the counterpart to the pharmacophore of small molecules. Examples of payloads include, but are not limited to, coagulation factors, cytokines, enzymes, hormones, and blood and growth factors.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

As used herein, "treat" or "treating," or "palliating" or "ameliorating" are used interchangeably and mean administering a drug or a biologic to achieve a therapeutic benefit, to cure or reduce the severity of an existing condition, or to achieve a prophylactic benefit, prevent or reduce the likelihood of onset or severity the occurrence of a condition. By therapeutic benefit is meant eradication or amelioration of the underlying condition being treated or one or more of the physiological symptoms associated with the underlying condition such that an improvement is observed in the subject, notwithstanding that the subject may still be afflicted with the underlying condition.

A "therapeutic effect" or "therapeutic benefit," as used herein, refers to a physiologic effect, including but not limited to the mitigation, amelioration, or prevention of disease in humans or other animals, or to otherwise enhance physical or mental wellbeing of humans or animals, resulting from administration of a fusion protein of the invention other than the ability to induce the production of an antibody against an antigenic epitope possessed by the biologically active protein. For prophylactic benefit, the compositions may be administered to a subject at risk of developing a particular disease, condition or symptom of the disease (e.g., a bleed in a diagnosed hemophilia A subject), or to a subject reporting one or more of the physiological symptoms of a disease, even though a diagnosis of this disease may not have been made.

The terms "therapeutically effective amount" and "therapeutically effective dose", as used herein, refer to an amount of a drug or a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial. Determination of a therapeutically effective amount is well within the capability of those skilled in the art, especially in light of the detailed disclosure provided herein.

The term "therapeutically effective dose regimen", as used herein, refers to a schedule for consecutively administered multiple doses (i.e., at least two or more) of a biologically active protein, either alone or as a part of a fusion protein composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," 3$^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," 11$^{th}$ Edition, McGraw-Hill, 2005; and Freshney, R. I., "Culture of Animal Cells: A Manual of Basic Technique," 4$^{th}$ edition, John Wiley & Sons, Somerset, N.J., 2000, the contents of which are incorporated in their entirety herein by reference.

II). Coagulation Factor VIII

The present invention relates, in part, to compositions comprising factor VIII coagulation factor (CF) linked to one or more extended recombinant proteins (XTEN), resulting in a CFXTEN fusion protein composition. As used herein, "CF" refers to factor V111 (FVIII) or mimetics, sequence variants and truncated versions of FVIII, as described below.

"Factor VIII" or "FVIII" or "FVIII protein" means a blood coagulation factor protein and species (including human, porcine, canine, rat or murine FVIII proteins) and sequence variants thereof that includes, but is not limited to the 2351 amino acid single-chain precursor protein (with a 19-amino acid hydrophobic signal peptide), the mature 2332 amino acid factor VIII cofactor protein of approximately 270-330 kDa with the domain structure A1-A2-B-A3-C1-C2, as well as the nonenzymatic "active" or cofactor form of FVIII (FVIIIa) that is a circulating heterodimer of two chains that form as a result of proteolytic cleavage after R1648 of a heavy chain form composed of A1-A2-B (in the range of 90-220 kD) of amino acids 1-1648 (numbered relative to the mature FVIII form) and a light chain A3-C1-C2 of 80 kDa of amino acids 1649-2232, each of which is depicted schematically in FIG. 1. Further, and as used herein, each of A1, A2 and the A3 domain encompasses acidic spacer regions; a1, a2, and a3 acidic regions, respectively. Thus, it will be understood that CFXTEN constructs described as having A1, A2, A3, B, C1 and C2 domains include the a1, a2 and a3 acidic regions. As used herein, "Factor VIII" or "FVIII" or "FVIII polypeptide" also includes variant forms, including proteins with substitutions, additions and/or deletions so long as the variant retains a desired biological activity such as procoagulant activity. Myriad functional FVIII variants have been constructed and can be used as recombinant FVIII proteins as described herein. See PCT Publication Nos. WO 2011/069164 A2, WO 2012/006623 A2, WO 2012/006635 A2, or WO 2012/006633 A2, all of which are incorporated herein by reference in their entireties. A great many functional FVIII variants are known. In addition, hundreds of nonfunctional mutations in FVIII have been identified in hemophilia patients. See, e.g., Cutler et al., Hum. Mutat. 19:274-8 (2002), incorporated herein by reference in its entirety. In addition, comparisons between FVIII from humans and other species have identified conserved residues that are likely to be required for function. See, e.g., Cameron et al., Thromb. Haemost. 79:317-22 (1998) and U.S. Pat. No. 6,251,632, incorporated herein by reference in their entireties.

In one embodiment, the human factor VIII domains are defined by the following amino acid residues: A1, residues Ala1-Arg372; A2, residues Ser373-Arg740; B, residues Ser741-Arg1648; A3, residues Ser1649-Asn2019; C1, residues Lys2020-Asn2172; C2, residues Ser2173-Tyr2332. The A3-C1-C2 sequence includes residues Ser1649-Tyr2332. In another embodiment, residues Arg336-Arg372 is usually referred to as the a1 region, and the Arg372 is cleaved by thrombin. In certain embodiments, the a2 region is part of the A1 domain. In another embodiment, residues Glu1649-Arg1689, is referred to as the a3 acidic region. In certain embodiments, the a3 acidic region is a part of the A3 domain. In another embodiment, a native FVIII protein has the following formula: A1-a1-A2-a2-B-a3-A3-C1-C2, where A1, A2, and A3 are the structurally-related "A domains," B is the "B domain," C1 and C2 are the structurally-related "C domains," and a1, a2 and a3 are acidic spacer regions. In the foregoing formula and referring to the primary amino acid sequence position in FIG. 30, the A1 domain of human FVIII extends from Ala1 to about Arg336, the a1 spacer region extends from about Met337 to about Arg372, the A2 domain extends from about Ser373 to about Tyr719, the a2 spacer region extends from about Glu720 to about Arg740, the B domain extends from about Ser741 to about Arg 1648, the a3 spacer region extends from about Glu1649 to about Arg1689, the A3 domain extends from about Ser1690 to about Asn2019, the C1 domain extends from about Lys2020 to about Asn2172, and the C2 domain extends from about Ser2173 to Tyr2332 (Saenko et al., 2005, J Thromb Hemostasis, 1, 922-930). Other than specific proteolytic cleavage sites, designation of the locations of the boundaries between the domains and regions of FVIII can vary in different literature references. The boundaries noted herein are therefore designated as approximate by use of the term "about."

Such factor VIII include truncated sequences such as B-domain deleted "BDD" sequences in which a portion or the majority of the B domain sequence is deleted (such as BDD sequences disclosed or referenced in U.S. Pat. Nos. 6,818,439 and 7,632,921). An example of a BDD FVIII is REFACTO® or XYNTHA® (recombinant BDD FVIII), which comprises a first polypeptide corresponding to amino acids 1 to 743 of FIG. 30, fused to a second polypeptide corresponding to amino acids 1638 to 2332 of FIG. 30. Exemplary BDD FVIII constructs which can be used to produce recombinant proteins of the invention include, but are not limited to FVIII with a deletion of amino acids corresponding to amino acids 747-1638 of mature human FVIII (FIG. 30) (Hoeben R. C., et al. J. Biol. Chem. 265 (13): 7318-7323 (1990), incorporated herein by reference in its entirety), and FVIII with a deletion of amino acids corresponding to amino acids 771-1666 or amino acids 868-1562 of mature human FVIII (FIG. 30) (Meulien P., et al. Protein Eng. 2(4): 301-6 (1988), incorporated herein by reference in its entirety).

In addition, sequences that include heterologous amino acid insertions or substitutions (such as aspartic acid substituted for valine at position 75), or single chain FVIII (scFVIII) in which the heavy and light chains are covalently connected by a linker. As used herein, "FVIII" shall be any functional form of factor VIII molecule with the typical characteristics of blood coagulation factor VIII capable of correcting human factor VIII deficiencies when administered to such a subject, e.g., a subject with hemophilia A. FVIII or sequence variants have been isolated, characterized, and cloned, as described in U.S. Pat. Nos. 4,757,006; 4,965,199; 5,004,804; 5,198,349, 5,250,421; 5,919,766; 6,228,620; 6,818,439; 7,138,505; 7,632,921; and 20100081615.

Human factor VIII is encoded by a single-copy gene residing at the tip of the long arm of the X chromosome (q28). It comprises nearly 186,000 base pairs (bp) and constitutes approximately 0.1% of the X-chromosome (White, G. C. and Shoemaker, C. B., Blood (1989) 73:1-12). The human FVIII amino acid sequence was deduced from cDNA as shown in U.S. Pat. No. 4,965,199, which is incorporated herein by reference in its entirety. Native mature human FVIII derived from the cDNA sequence (i.e., without the secretory signal peptide but prior to other post-translational processing) is presented as FIG. 3.

The DNA encoding the mature factor VIII mRNA is found in 26 separate exons ranging in size from 69 to 3,106 bp. The 25 intervening intron regions that separate the exons range in size from 207 to 32,400 bp. The complete gene consists of approximately 9 kb of exon and 177 kb of intron. The three repeat A domains have approximately 30% sequence homology. The B domain contains 19 of the approximately 25 predicted glycosylation sites, and the A3 domain is believed to contain a binding site for the von Willebrand factor. The tandem C domains follow the A3 domain and have approximately 37% homology to each other (White, G. C. and Shoemaker, C. B., Blood (1989) 73:1-12).

Figure 2:
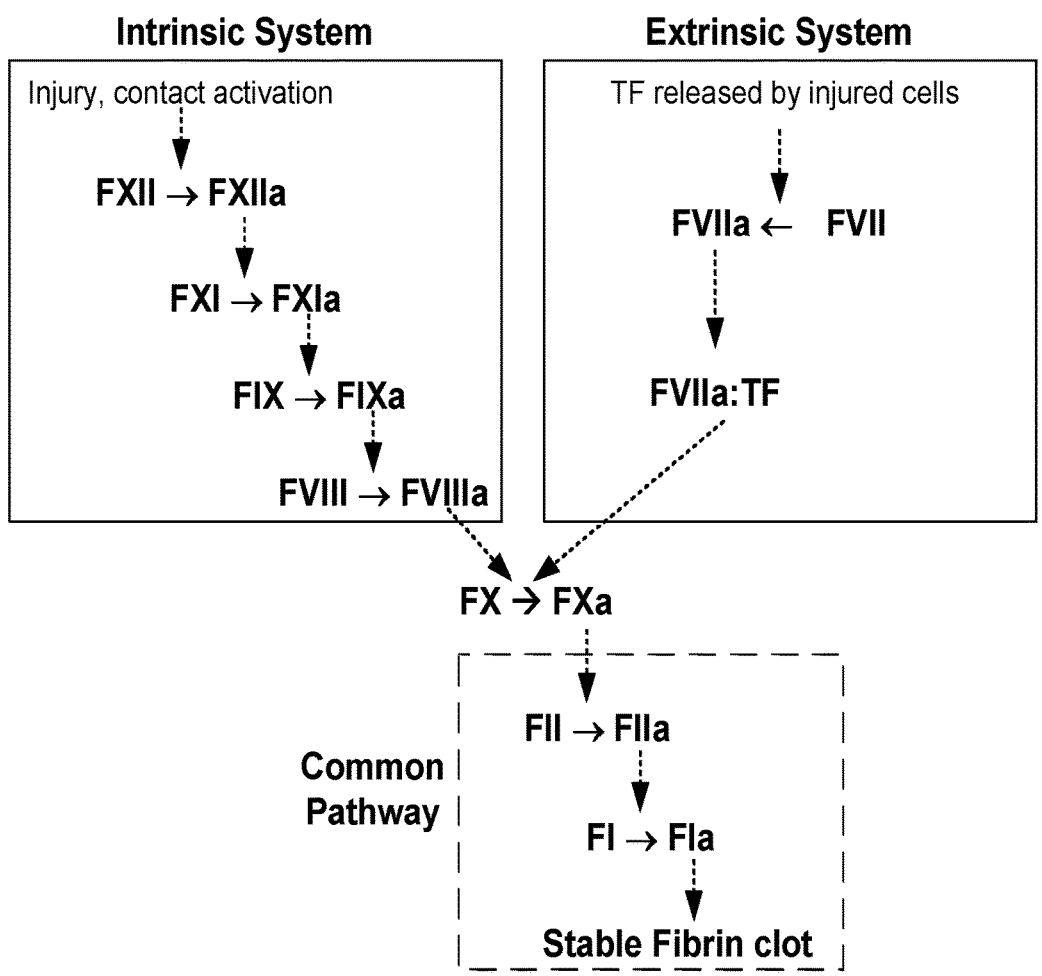
FIG. 2 is a schematic of the coagulation cascade, showing the intrinsic and extrinsic arms leading to the common pathway.

The B domain separates the A2 and A3 domains of native factor FVIII in the newly synthesized precursor single-chain molecule. The precise boundaries of the B domain have been variously reported as extending from amino acids 712 to 1648 of the precursor sequence (Wood et al., Nature (1984) 312:330-337) or amino acids 741-1648 (Pipe, S W, Haemophilia (2009) 15:1187-1196 and U.S. Pat. No. 7,560,107) or amino acids 740-1689 (Toole, J J. Proc. Natl. Acad. Sci. USA (1986) 83:5939-5942). As used herein, "B domain" means amino acids 741-1648 of mature factor VIII. As used herein, "FVIII B domain deletion" or "FVIII BDD" means a FVIII sequence with any, a fragment of, or all of amino acids 741 to 1648 deleted. In one embodiment, FVIII BDD variants retain remnant amino acids of the B domain from the N-terminal end ("B1" as used herein) and C-terminal end ("B2" as used herein). In one FVIII BDD variant, the B domain remnant amino acids are SFSQNPPVLKRHQR (SEQ ID NO: 1614). In one FVIII BDD variant, the B1 remnant is SFS and the B2 remnant is QNPPVLKRHQR (SEQ ID NO: 1615). In another FVIII BDD variant, the B1 remnant is SFSQN (SEQ ID NO: 1616) and the B2 remnant is PPVLKRHQR (SEQ ID NO: 1617). A "B-domain-deleted factor VIII," "FVIII BDD," or "BDD FVIII" may have the full or partial deletions disclosed in U.S. Pat. Nos. 6,316, 226, 6,346,513, 7,041,635, 5,789,203, 6,060,447, 5,595,886, 6,228,620, 5,972,885, 6,048,720, 5,543,502, 5,610,278, 5,171,844, 5,112,950, 4,868,112, and 6,458,563, each of which is incorporated herein by reference in its entirety. In some embodiments, a B-domain-deleted factor VIII sequence of the present invention comprises any one of the deletions disclosed at col. 4, line 4 to col. 5, line 28 and examples 1-5 of U.S. Pat. No. 6,316,226 (also in U.S. Pat. No. 6,346,513). In another embodiment, a B-domain deleted factor VIII is the S743/Q1638 B-domain deleted factor V111 (SQ version factor VIII) (e.g., factor VIII having a deletion from amino acid 744 to amino acid 1637, e.g., factor VIII having amino acids 1-743 and amino acids 1638-2332 of full-length factor VIII). In some embodiments, a B-domain-deleted factor VIII of the present invention has a deletion disclosed at col. 2, lines 26-51 and examples 5-8 of U.S. Pat. No. 5,789,203 (also U.S. Pat. No. 6,060,447, 5,595,886, and 6,228,620). In some embodiments, a B-domain-deleted factor VIII has a deletion described in col. 1, lines 25 to col. 2, line 40 of U.S. Pat. No. 5,972,885; col. 6, lines 1-22 and example 1 of U.S. Pat. No. 6,048,720; col. 2, lines 17-46 of U.S. Pat. No. 5,543,502; col. 4, line 22 to col. 5, line 36 of U.S. Pat. No. 5,171,844; col. 2, lines 55-68, FIG. 2, and example 1 of U.S. Pat. No. 5,112,950; col. 2, line 2 to col. 19, line 21 and table 2 of U.S. Pat. No. 4,868,112; col. 2, line 1 to col. 3, line 19, col. 3, line 40 to col. 4, line 67, col. 7, line 43 to col. 8, line 26, and col. 11, line 5 to col. 13, line 39 of U.S. Pat. No. 7,041,635; or col. 4, lines 25-53, of U.S. Pat. No. 6,458,563. In some embodiments, a B-domain-deleted factor VIII has a deletion of most of the B domain, but still contains amino-terminal sequences of the B domain that are essential for in vivo proteolytic processing of the primary translation product into two polypeptide chain, as disclosed in WO 91/09122, which is incorporated herein by reference in its entirety. In some embodiments, a B-domain-deleted factor VIII is constructed with a deletion of amino acids 747-1638, i.e., virtually a complete deletion of the B domain. Hoeben R. C., et al. *J. Biol. Chem.* 265 (13): 7318-7323 (1990), incorporated herein by reference in its entirety. A B-domain-deleted factor VIII may also contain a deletion of amino acids 771-1666 or amino acids 868-1562 of factor VIII. Meulien P., et al. *Protein Eng.* 2(4): 301-6 (1988), incorporated herein by reference in its entirety. Additional B domain deletions that are part of the invention include: deletion of amino acids 982 through 1562 or 760 through 1639 (Toole et al., *Proc. Natl. Acad. Sci. U.S.A.* (1986) 83, 5939-5942)), 797 through 1562 (Eaton, et al. *Biochemistry* (1986) 25:8343-8347)), 741 through 1646 (Kaufman (PCT published application No. WO 87/04187)), 747-1560 (Sarver, et al., DNA (1987) 6:553-564)), 741 though 1648 (Pasek (PCT application No. 88/00831)), or 816 through 1598 or 741 through 1648 (Lagner (Behring Inst. Mitt. (1988) No 82:16-25, EP 295597)), each of which is incorporated herein by reference in its entirety. Each of the foregoing deletions may be made in any factor VIII sequence utilized in the embodiments of the present invention.

Proteins involved in clotting include factor I, factor II, factor III, factor IV, factor V, factor VI, factor VII, factor VIII, factor IX, factor X, factor XI, factor XII, factor XIII, Protein C, and tissue factor (collectively or individually "clotting protein(s)"). The interaction of the major clotting proteins in the intrinsic and extrinsic clotting pathways is showed in FIG. 2. The majority of the clotting proteins are present in zymogen form, but when activated, exhibit a procoagulant protease activity in which they activate another of the clotting proteins, contributing to the intrinsic or extrinsic coagulation pathway and clot formation. In the intrinsic pathway of the coagulation cascade, FVIII associates with a complex of activated factor IX, factor X, calcium, and phospholipid. The factor VIII heterodimer has no enzymatic activity, but the heterodimer becomes active as a cofactor of the enzyme factor IXa after proteolytic activation by thrombin or factor Xa, with the activity of factor VIIIa characterized by its ability to form a membrane binding site for factors IXa and X in a conformation suitable for activation of the factor X by factor IXa. Upon cleavage by thrombin, activated FVIII (FVIIIa) dissociates from von Willebrand factor and binds to negatively charged phospholipid PL, and the resulting complex participates as a cofactor to factor IXa in the factor X activating (tenase) complex. Within the C2 domain and amino acid residues 1649 through 1689 in the A3 domain are von Willebrand factor (vWF) binding sites that act to complex with von Willebrand factor, the resulting circulating complex protects FVIII from rapid degradation in the blood (Weiss H J, et al. Stabilization of factor VIII in plasma by the von Willebrand factor. Studies on posttransfusion and dissociated factor VIII and in patients with von Willebrand's disease. J Clin Invest (1977) 60:390).

Activated factor VIII is a heterotrimer comprised of the A1 domain and the A2 domain and the light chain including domains A3-C1-C2. The activation of factor IX is achieved by a two-step removal of the activation peptide (Ala 146-Arg 180) from the molecule (Bajaj et al., Human factor 1× and factor IXa, in METHODS IN ENZYMOLOGY. 1993). The first cleavage is made at the Arg 145-Ala 146 site by either factor XIa or factor VIIa/tissue factor. The second, and rate limiting cleavage is made at Arg 180-Val 181. The activation removes 35 residues. Activated human factor IX exists as a heterodimer of the C-terminal heavy chain (28 kDa) and an N-terminal light chain (18 kDa), which are held together by one disulfide bridge attaching the enzyme to the Gla domain. Factor IXa in turn activates factor X in concert with activated factor VIII. Alternatively, factors 1× and X can both be activated by factor VIIa complexed with lipidated tissue factor, generated via the extrinsic pathway. Factor Xa then participates in the final common pathway whereby prothrombin is converted to thrombin, and thrombin, in turn converts fibrinogen to fibrin to form the clot.

Defects in the coagulation process can lead to bleeding disorders (coagulopathies) in which the time taken for clot formation is prolonged. Such defects can be congenital or acquired. For example, hemophilia A and B are inherited diseases characterized by deficiencies in FVIII and FIX, respectively. Stated differently, biologically active factor VIII corrects the coagulation defect in plasma derived from individuals afflicted with hemophilia A. Recombinant FVIII has been shown to be effective and has been approved for the treatment of hemophilia A in adult and pediatric patients, and also is used to stop bleeding episodes or prevent bleeding associated with trauma and/or surgery. Current therapeutic uses of factor VIII can be problematic in the treatment of individuals exhibiting a deficiency in factor VIII, as well as those individuals with Von Willebrand's disease. In addition, individuals receiving factor VIII in replacement therapy frequently develop antibodies to these proteins that often reduce or eliminate the procoagulant activity of the bound FVIII. Continuing treatment is exceedingly difficult because of the presence of these antibodies that reduce or negate the efficacy of the treatment.

In one aspect, the invention contemplates inclusion of FVIII sequences in the CFXTEN fusion protein compositions that are identical to human FVIII, sequences that have homology to FVIII sequences, sequences that are natural, such as from humans, non-human primates, mammals (including domestic animals), or truncated version of FVIII; all of which retain at least a portion of the procoagulant activity of native FVIII and that are useful for preventing, treating, mediating, or ameliorating hemophilia A or bleeding episodes related to trauma, surgery, or deficiency of coagulation factor VIII. Sequences with homology to FVIII may be found by standard homology searching techniques, such as NCBI BLAST, or in public databases such as Chemical Abstracts Services Databases (e.g., the CAS Registry), GenBank, The Universal Protein Resource (UniProt) and subscription provided databases such as GenSeq (e.g., Derwent).

In one embodiment, the FVIII incorporated into the subject CFXTEN compositions is a recombinant polypeptide with a sequence corresponding to a FVIII protein found in nature. In another embodiment, the FVIII is a non-natural FVIII sequence variant, fragment, homolog, or a mimetic of a natural sequence that retains at least a portion of the procoagulant activity of the corresponding native FVIII. In another embodiment, the FVIII is a truncated variant with all or a portion of the B domain deleted ("FVIII BDD"), which can be in either heterodimeric form or can remain as a single chain ("scFVIII"), the latter described in Meulien et al., Protein Eng. (1988) 2(4):301-306. Non-limiting examples of FVIII BDD are factor VIII sequences in which the amino acids are deleted between residue number 741 and residue number 1640 (numbered relative to native, mature FVIII), or between residue number 745 and residue number 1640, or between residue number 745 and residue number 1640, or between residue number 741 and residue number 1690, or between residue number 745 and residue number 1667, or between residue number 745 and residue number 1657, or between residue number 747 and residue number 1642, or between residue number 751 and residue number 1667.

In another embodiment, heterologous sequences are incorporated into the FVIII, which may include XTEN, as described more fully below. Table 1 provides a non-limiting list of amino acid sequences of FVIII that are encompassed by the CFXTEN fusion proteins of the invention. In some embodiments, FVIII incorporated into CFXTEN fusion proteins include proteins that have at least about 70% sequence identity, or alternatively 80%, 81%, 82%, 83%, 84%, 85%, 86%, 87%, 88%, 89%, 90%, 91%, 92%, 93%, 94%, 95%, 96%, 97%, 98%, 99%, or 100% sequence identity compared to an amino acid sequence of comparable length selected from Table 1.

TABLE 1

FVIII amino acid sequences

| Name (source) | Amino Acid Sequence | SEQ ID NO: |
|---|---|---|
| FVIII precursor polypeptide (human) | MQIELSTCFFLCLLRFCFSATRRYYLGAVELSWDYMQSDLGELPVDARFPPRVPK SFPPNTSVVYKKTLFVEFTDHLFNIAKPRPPWMGLLGPTIQAEVYDTVVITLKNM ASHPVSLHAVGVSYWKASEGAEYDDQTSQREKEDDKVFPGGSHTYVWQVLKEN GPMASDPLCLTYSYLSHVDLVKDLNSGLIGALLVCREGSLAKEKTQTLHKFILLF AVFDEGKSWHSETKNSLMQDRDAASARAWPKMHTVNGYVNRSLPGLIGCHRKS VYWHVIGMGTTPEVHSIFLEGHTFLVRNHRQASLEISPITFLTAQTLLMDLGQFLL FCHISSSHQHDGMEAYVKVDSCPEEPQLRMKNNEEAEDYDDDLTDSEMDVVRFD DDNSPSFIQIRSVAKKHPKTWVHYIAAEEEDWDYAPLVLAPDDRSYKSQYLNNG PQRIGRKYKKVRFMAYTDETFKTREAIQHESGILGPLLYGEVGDTLLIIFKNQASR PYNIYPHGITDVRPLYSRRLPKGVKHLKDFPILPGEIFKYKWTVTVEDGPTKSDPR CLTRYYSSFVNMERDLASGLIGPLLICYKESVDQRGNQIMSDKRNVILFSVFDENR SWYLTENIQRFLPNPAGVQLEDPEFQASNIMHSINGYVFDSLQLSVCLHEVAYWY ILSIGAQTDFLSVFFSGYTFKHKMVYEDTLTLFPFSGETVFMSMENPGLWILGCHN SDFRNRGMTALLKVSSCDKNTGDYYEDSYEDISAYLLSKNNAIEPRSFSQNSRHPS TRQKQFNATTIPENDIEKTDPWFAHRTPMPKIQNVSSSDLLMLLRQSPTPHGLSLS DLQEAKYETFSDDPSPGAIDSNNSLSEMTHFRPQLHHSGDMVFTPESGLQLRLNE KLGTTAATELKKLDFKVSSTSNNLISTIPSDNLAAGTDNTSSLGPPSMPVHYDSQL DTTLFGKKSSPLTESGGPLSLSEENNDSKLLESGLMNSQESSWGKNVSSTESGRLF KGKRAHGPALLTKDNALFKVSISLLKTNKTSNNSATNRKTHIDGPSLLIENSPSVW QNILESDTEFKKVTPLIHDRMLMDKNATALRLNHMSNKTTSSKNMEMVQQKKE GPIPPDAQNPDMSFFKMLFLPESARWIQRTHGKNSLNSGQGPSPKQLVSLGPEKSV EGQNFLSEKNKVVVGKGEFTKDVGLKEMVFPSSRNLFLTNLDNLHENNTHNQEK KIQEEIEKKETLIQENVVLPQIHTVTGTKNFMKNLFLLSTRQNVEGSYDGAYAPVL QDFRSLNDSTNRTKKHTAHFSKKGEEENLEGLGNQTKQIVEKYACTTRISPNTSQ QNFVTQRSKRALKQFRLPLEETELEKRIIVDDTSTQWSKNMKHLTPSTLTQIDYNE KEKGAITQSPLSDCLTRSHSIPQANRSPLPIAKVSSFPSIRPIYLTRVLFQDNSSHLPA ASYRKKDSGVQESSHFLQGAKKNNLSLAILTLEMTGDQREVGSLGTSATNSVTY KKVENTVLPKPDLPKTSGKVELLPKVHIYQKDLFPTETSNGSPGHLDLVEGSLLQ GTEGAIKWNEANRPGKVPFLRVATESSAKTPSKLLDPLAWDNHYGTQIPKEEWK SQEKSPEKTAFKKKDTILSLNACESNHAIAAINEGQNKPEIEVTWAKQGRTERLCS QNPPVLKRHQREITRTTLQSDQEEIDYDDTISVEMKKEDFDIYDEDENQSPRSFQK KTRHYFIAAVERLWDYGMSSSPHVLRNRAQSGSVPQFKKVVFQEFTDGSFTQPL YRGELNEHLGLLGPYIRAEVEDNIMVTFRNQASRPYSFYSSLISYEEDQRQGAEPR KNFVKPNETKTYFWKVQHHMAPTKDEFDCKAWAYFSDVDLEKDVHSGLIGPLL VCHTNTLNPAHGRQVTVQEFALFFTIFDETKSWYFTENMERNCRAPCNIQMEDPT FKENYRFHAINGYIMDTLPGLVMAQDQRIRWYLLSMGSNENIHSIHFSGHVFTVR KKEEYKMALYNLYPGVFETVEMLPSKAGIWRVECLIGEHLHAGMSTLFLVYSNK CQTPLGMASGHIRDFQITASGQYGQWAPKLARLHYSGSINAWSTKEPFSWIKVDL LAPMIIHGIKTQGARQKFSSLYISQFIIMYSLDGKKWQTYRGNSTGTLMVFFGNVD SSGIKHNIFNPPIIARYIRLHPTHYSIRSTLRMELMGCDLNSCSMPLGMESKAISDA QITASSYFTNMFATWSPSKARLHLQGRSNAWRPQVNNPKEWLQVDFQKTMKVT GVTTQGVKSLLTSMYVKEFLISSSQDGHQWTLFFQNGKVKVFQGNQDSFTPVVN SLDPPLLTRYLRIHPQSWVHQIALRMEVLGCEAQDLY | 1 |
| FVIII mature (human) | ATRRYYLGAVELSWDYMQSDLGELPVDARFPPRVPKSFPPNTSVVYKKTLFVEFT DHLFNIAKPRPPWMGLLGPTIQAEVYDTVVITLKNMASHPVSLHAVGVSYWKAS EGAEYDDQTSQREKEDDKVFPGGSHTYVWQVLKENGPMASDPLCLTYSYLSHV DLVKDLNSGLIGALLVCREGSLAKEKTQTLHKFILLFAVFDEGKSWHSETKNSLM QDRDAASARAWPKMHTVNGYVNRSLPGLIGCHRKSVYWHVIGMGTTPEVHSIFL EGHTFLVRNHRQASLEISPITFLTAQTLLMDLGQFLLFCHISSSHQHDGMEAYVKV DSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDE TFKTREAIQHESGILGPLLYGEVGDTLLIIFKNQASRPYNIYPHGITDVRPLYSRRLP KGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFK HKMVYEDTLTLFPFSGETVFMSMENPGLWILGCHNSDFRNRGMTALLKVSSCDK NTGDYYEDSYEDISAYLLSKNNAIEPRSFSQNSRHPSTRQKQFNATTIPENDIEKTD PWFAHRTPMPKIQNVSSSDLLMLLRQSPTPHGLSLSDLQEAKYETFSDDPSPGAID SNNSLSEMTHFRPQLHHSGDMVFTPESGLQLRLNEKLGTTAATELKKLDFKVSST SNNLISTIPSDNLAAGTDNTSSLGPPSMPVHYDSQLDTTLFGKKSSPLTESGGPLSL SEENNDSKLLESGLMNSQESSWGKNVSSTESGRLFKGKRAHGPALLTKDNALFK VSISLLKTNKTSNNSATNRKTHIDGPSLLIENSPSVWQNILESDTEFKKVTPLIHDR MLMDKNATALRLNHMSNKTTSSKNMEMVQQKKEGPIPPDAQNPDMSFFKMLFL PESARWIQRTHGKNSLNSGQGPSPKQLVSLGPEKSVEGQNFLSEKNKVVVGKGEF TKDVGLKEMVFPSSRNLFLTNLDNLHENNTHNQEKKIQEEIEKKETLIQENVVLP QIHTVTGTKNFMKNLFLLSTRQNVEGSYDGAYAPVLQDFRSLNDSTNRTKKHTA HFSKKGEEENLEGLGNQTKQIVEKYACTTRISPNTSQQNFVTQRSKRALKQFRLPL EETELEKRIIVDDTSTQWSKNMKHLTPSTLTQIDYNEKEKGAITQSPLSDCLTRSHS IPQANRSPLPIAKVSSFPSIRPIYLTRVLFQDNSSHLPAASYRKKDSGVQESSHFLQG AKKNNLSLAILTLEMTGDQREVGSLGTSATNSVTYKKVENTVLPKPDLPKTSGKV ELLPKVHIYQKDLFPTETSNGSPGHLDLVEGSLLQGTEGAIKWNEANRPGKVPFL RVATESSAKTPSKLLDPLAWDNHYGTQIPKEEWKSQEKSPEKTAFKKKDTILSLN ACESNHAIAAINEGQNKPEIEVTWAKQGRTERLCSQNPPVLKRHQREITRTTLQSD | 2 |

TABLE 1-continued

FVIII amino acid sequences

| Name (source) | Amino Acid Sequence | SEQ ID NO: |
|---|---|---|
| | QEEIDYDDTISVEMKKEDFDIYDEDENQSPRSFQKKTRHYFIAAVERLWDYGMSS SPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHH MAPTKDEFDCKAWAYFSDVDLEKDVHSGLIGPLLVCHTNTLNPAHGRQVTVQEF ALFFTIFDETKSWYFTENMERNCRAPCNIQMEDPTFKENYRFHAINGYIMDTLPGL VMAQDQRIRWYLLSMGSNENIHSIHFSGHVFTVRKKEEYKMALYNLYPGVFETV EMLPSKAGIWRVECLIGEHLHAGMSTLFLVYSNKCQTPLGMASGHIRDFQITASG QYGQWAPKLARLHYSGSINAWSTKEPFSWIKVDLLAPMIIHGIKTQGARQKFSSL YISQFIIMYSLDGKKWQTYRGNSTGTLMVFFGNVDSSGIKHNIFNPPIIARYIRLHP THYSIRSTLRMELMGCDLNSCSMPLGMESKAISDAQITASSYFTNMFATWSPSKA RLHLQGRSNAWRPQVNNPKEWLQVDFQKTMKVTGVTTQGVKSLLTSMYVKEF LISSSQDGHQWTLFFQNGKVKVFQGNQDSFTPVVNSLDPPLLTRYLRIHPQSWVH QIALRMEVLGCEAQDLY | |
| FVIII (Canine) | MQVELYTCCFLCLLPFSLSATRKYYLGAVELSWDYMQSDLLSALHADTSFSSRVP GSLPLTTSVTYRKTVFVEFTDDLFNIAKPRPPWMGLLGPTIQAEVYDTVVIVLKN MASHPVSLHAVGVSYWKASEGAEYEDQTSQKEKEDDNVIPGESHTYVWQVLKE NGPMASDPPCLTYSYFSHVDLVKDLNSGLIGALLVCKEGSLAKERTQTLQEFVLL FAVFDEGKSWHSETNASLTQAEAQHELHTINGYVNRSLPGLTVCHKRSVYWHVI GMGTTPEVHSIFLEGHTFLVRNHRQASLEISPITFLTAQTFLMDLGQFLLFCHIPSH QHDGMEAYVKVDSCPEEPQLRMKNNEDKDYDDGLYDSDMDVVSFDDDSSSPFI QIRSVAKKHPKTWVHYIAAEEEDWDYAPSGPTPNDRSHKNLYLNNGPQRIGKKY KKVRFVAYTDETFKTREAIQYESGILGPLLYGEVGDTLLIIFKNQASRPYNIYPHGI NYVTPLHTGRLPKGVKHLKDMPILPGEIFYKWTVTVEDGPTKSDPRCLTRYYSS FINLERDLASGLIGPLLICYKESVDQRGNQMMSDKRNVILFSVFDENRSWYLTEN MQRFLPNADVVQPHDPEFQLSNIMHSINGYVFDNLQLSVCLHEVAYWYILSVGA QTDFLSVFFSGYTFKHKMVYEDTLTLFPPSGETVFMSMENPGLWVLGCHNSDFR NRGMTALLKVSSCNRNIDDYYEDTYEDIPTPLLNENNVIKPRSFSQNSRHPSTKEK QLKATTTPENDIEKIDLQSGERTQLIKAQSVSSSDLLMLLGQNPTPRGLFLSDLREA TDRADDHSRGAIERNKGPPEVASLRPELRHSEDREFTPEPELQLRLNENLGTNTTV ELKKLDLKISSSSDSLMTSPTIPSDKLAAATEKTGSLGPPNMSVHFNSHLGTIVFGN NSSHLIQSGVPLELSEEDNDSKLLEAPLMNIQESSLRENVLSMESNRLFKEERIRGP ASLIKDNALFKVNISSVKTNRAPVNLTTNRKTRVAIPTLLIENSTSVWQDIMLERN TEFKEVTSLIHNETFMDRNTTALGLNHVSNKTTLSKNVEMAHQKKEDPVPLRAE NPDLSSSKIPFLPDWIKTHGKNSLSSEQRPSPKQLTSLGSEKSVKDQNFLSEEKVVV GEDEFTKDTELQEIFPNNKSIFFANLANVQENDTYNQEKKSPEEIERKEKLTQENV ALPQAHTMIGTKNFLKNLFLLSTKQNVAGLEEQPYTPILQDTRSLNDSPHSEGIHM ANFSKIREEANLEGLGNQTNQMVERFPSTTRMSSNASQHVITQRGKRSLKQPRLS QGEIKFERKVIANDTSTQWSKNMNYLAQGTLTQIEYNEKEKRAITQSPLSDCSMR NHVTIQMNDSALPVAKESASPSVRHTDLTKIPSQHNSSHLPASACNYTFRERTSGV QEGSHFLQEAKRNNLSLAFVTLGITEGQGKFSSLGKSATNQPMYKKLENTVLLQP GLSETSDKVELLSQVHVDQEDSFPTKTSNDSPGHLDLMGKIFLQKTQGPVKMNK TNSPGKVPFLKWATESSEKIPSKLLGVLAWDNHYDTQIPSEEWKSQKKSQTNTAF KRKDTILPLGPCENNDSTAAINEGQDKPQREAMWAKQGEPGRLCSQNPPVSKHH QREITVTTLQPEEDKFEYDDTFSIEMKREDFDIYGDYENQGLRSFQKKTRHYFIAA VERLWDYGMSRSPHILRNRAQSGDVQQFKKVVFQEFTDGSFTQPLYRGELNEHL GLLGPYIRAEVEDNIVVTFKNQASRPYSFYSSLISYDEDEGQGAEPRRKFVNPNET KIYFWKVQHHMAPTKDEFDCKAWAYFSDVDLEKDVHSGLIGPLLICRSNTLNPA HGRQVTVQEFALVFTIFDETKSWYFTENLERNCRAPCNVQKEDPTLKENFRFHAI NGYVKDTLPGLVMAQDQKVRWYLLSMGSNENIHSIHFSGHVFTVRKKEEYKMA VYNLYPGVFETVEMLPSQVGIWRIECLIGEHLQAGMSTLFLVYSKKCQTPLGMAS GHIRDFQITASGQYGQWAPKLARLHYSGSINAWTKDPFSWIKVDLLAPMIIHGI MTQGARQKFSSLYVSQFIIMYSLDGNKWHSYRGNSTGTLMVFFGNVDSSGIKHNI FNPPIIAQYIRLHPTHYSIRSTLRMELLGCDFNSCSMPLGMESKAISDAQITASSYLS SMLATWSPSQARLHLQGRTNAWRPQANNPKEWLQVDFRKTMKVTGITTQGVKS LLISMYVKEFLISSSQDGHNWTLFLQNGKVKVFQGNRDSSTPVRNRLEPPLVARY VR LHPQSWAHHIALRLEVLGCDTQQPA | 3 |
| FVIII (Pig) | ATRRYYLGAVELSWDYMQSDLGELPVDARFPPRVPKSFPPFNTSVVYKKTLFVEFT DHLFNIAKPRPPWMGLLGPTIQAEVYDTVVITLKNMASHPVSLHAVGVSYWKAS EGAEYDDQTSQREKEDDKVFPGGSHTYVWQVLKENGPMASDPLCLTYSYLSHV DLVKDLNSGLIGALLVCREGSLAKEKTQTLHKFILLFAVFDEGKSWHSETKNSLM QDRDAASARAWPKMHTVNGYVNRSLPGLIGCHRKSVYWHVIGMGTTPEVHSIFL EGHTFLVRNHRQASLEISPITFLTAQTLLMDLGQFLLFCHISSHQHDGMEAYVKV DSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDE TFKTREAIQHESGILGPLLYGEVGDTLLIIFKNQASRPYNIYPHGITDVRPLYSRRLP KGVKHLKDFPILPGEIFYKWTVTVEDGPTKSDPRCLTRYYSSFVNMERDLASGL IGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFK HKMVYEDTLTLFPPSGETVFMSMENPGLWILGCHNSDFRNRGMTALLKVSSCDK NTGDYYEDSYEDISAYLLSKNNAIEPRSFSQNSRHPSTRQKQFNATTIPENDIEKTD PWFAHRTPMPKIQNVSSSDLLMLLRQSPTPHGLSLSDLQEAKYETFSDDPSPGAID SNNSLSEMTHFRPQLHHSGDMVFTPESGLQLRLNEKLGTTAATELKKLDFKVSST | 4 |

TABLE 1-continued

FVIII amino acid sequences

| Name (source) | Amino Acid Sequence | SEQ ID NO: |
|---|---|---|
| | SNNLISTIPSDNLAAGTDNTSSLGPPSMPVHYDSQLDTTLFGKKSSPLTESGGPLSL SEENNDSKLLESGLMNSQESSWGKNVSSTESGRLFKGKRAHGPALLTKDNALFK VSISLLKTNKTSNNSATNRKTHIDGPSLLIENSPSVWQNILESDTEFKKVTPLIHDR MLMDKNATALRLNHMSNKTTSSKNMEMVQQKKEGPIPPDAQNPDMSFFKMLFL PESARWIQRTHGKNSLNSGQGPSPKQLVSLGPEKSVEGQNFLSEKNKVVVGKGEF TKDVGLKEMVFPSSRNLFLTNLDNLHENNTHNQEKKIQEEIEKKETLIQENVVLP QIHTVTGTKNFMKNLFLLSTRQNVEGSYDGAYAPVLQDFRSLNDSTNRTKKHTA HFSKKGEEENLEGLGNQTKQIVEKYACTTRISPNTSQQNFVTQRSKRALKQFRLPL EETELEKRIIVDDTSTQWSKNMKHLTPSTLTQIDYNEKEKGAITQSPLSDCLTRSHS IPQANRSPLPIAKVSSFPSIRPIYLTRVLFQDNSSHLPAASYRKKDSGVQESSHFLQG AKKNNLSLAILTLEMTGDQREVGSLGTSATNSVTYKKVENTVLPKPDLPKTSGKV ELLPKVHIYQKDLFPTETSNGSPGHLDLVEGSLLQGTEGAIKWNEANRPGKVPFL RVATESSAKTPSKLLDPLAWDNHYGTQIPKEEWKSQEKSPEKTAFKKKDTILSLN ACESNHAIAAINEGQNKPEIEVTWAKQGRTERLCSQNPPVLKRHQREITRTTLQSD QEEIDYDDTISVEMKKEDFDIYDEDENQSPRSFQKKTRHYFIAAVERLWDYGMSS SPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHH MAPTKDEFDCKAWAYFSDVDLEKDVHSGLIGPLLVCHTNTLNPAHGRQVTVQEF ALFFTIFDETKSWYFTENMERNCRAPCNIQMEDPTFKENYRFHAINGYIMDTLPGL VMAQDQRIRWYLLSMGSNENIHSIHFSGHVFTVRKKEEYKMALYNLYPGVFETV EMLPSKAGIWRVECLIGEHLHAGMSTLFLVYSNKCQTPLGMASGHIRDFQITASG QYGQWAPKLARLHYSGSINAWSTKEPFSWIKVDLLAPMIIHGIKTQGARQKFSSL YISQFIIMYSLDGKKWQTYRGNSTGTLMVFFGNVDSSGIKHNIFNPPIIARYIRLHP THYSIRSTLRMELMGCDLNSCSMPLGMESKAISDAQITASSYFTNMFATWSPSKA RLHLQGRSNAWRPQVNNPKEWLQVDFQKTMKVTGVTTQGVKSLLTSMYVKEF LISSSQDGHQWTLFFQNGKVKVFQGNQDSFTPVVNSLDPPLLTRYLRIHPQSWVH QIALRMEVLGCEAQDLY | |
| FVIII (Mouse) | AIRRYYLGAVELSWNYIQSDLLSVLHTDSRFLPRMSTSFPFNTSIMYKKTVFVEYK DQLFNIAKPRPPWMGLLGPTIWTEVHDTVVITLKNMASHPVSLHAVGVSYWKAS EGDEYEDQTSQMEKEDDKVFPGESHTYVWQVLKENGPMASDPPCLTYSYMSHV DLVKDLNSGLIGALLVCKEGSLSKERTQMLYQFVLLFAVFDEGKSWHSETNDSY TQSMDSASARDWPKMHTVNGYVNRSLPGLIGCHRKSVYWHVIGMGTTPEIHSIF LEGHTFFVRNHRQASLEISPITFLTAQTLLIDLGQFLLFCHISSHKHDGMEAYVKV DSCPEESQWQKKNNEEMEDYDDDLYSEMDMFTLDYDSSPFIQIRSVAKKYPKT WIHYISAEEEDWDYAPSVPTSDNGSYKSQYLSNGPHRIGRKYKKVRFIAYTDETF KTRETIQHESGLLGPLLYGEVGDTLLIIFKNQASRPYNIYPHGITDVSPLHARRLPR GIKHVKDLPIHPGEIFKYKWTVTVEDGPTKSDPRCLTRYYSSFINPERDLASGLIGP LLICYKESVDQRGNQMMSDKRNVILFSIFDENQSWYITENMQRFLPNAAKTQPQD PGFQASNIMHSINGYVFDSLELTVCLHEVAYWHILSVGAQTDFLSIFFSGYTFKHK MVYEDTLTLFPFSGETVFMSMENPGLWVLGCHNSDFRKRGMTALLKVSSCDKST SDYYEEIYEDIPTQLVNENNVIDPRSFFQNTNHPNTRKKKFKDSTIPKNDMEKIEPQ FEEIAEMLKVQSVSVSDMLLLGQSHPTPHGLFLSDGQEAIYEAIHDDHSPNAIDS NEGPSKVTQLRPESHHSEKIVFTPQPGLQLRSNKSLETTIEVGWKWKKLGLQVSSLPS NLMTTTILSDNLKATFEKTDSSGFPDMPVHSSSKLSTTAFGKKAYSLVGSHVPLN ASEENSDSNILDSTLMYSQESLPRDNILSIENDRLLREKRFHGIALLTKDNTLFKDN VSLMKTNKTYNHSTTNEKLHTESPTSIENSTTDLQDAILKVNSEIQEVTALIHDGT LLGKNSTYLRLNHMLNRTTSTKNKDIFHRKDEDPIPQDEENTIMPFSKMLFLSESS NWFKKTNGNNSLNSEQEHSPKQLVYLMFKKYVKNQSFLSEKNKVTVEQDGFTK NIGLKDMAFPHNMSIFLTTLSNVHENGRHNQEKNIQEEIEKEALIEEKVVLPQVHE ATGSKNFLKDILILGTRQNISLYEVHVPVLQNITSINNSTNTVQIHMEHFFKRRKDK ETNSEGLVNKTREMVKNYPSQKNITTQRSKRALGQFRLSTQWLKTINCSTQCIIKQ IDHSKEMKKFITKSSLSDSSVIKSTTQTNSSDSHIVKTSAFPPIDLKRSPFQNKFHV QASSYIYDFKTKSSRIQESNNFLKETKINNPSLAILPWNMFIDQGKFTSPGKSNTNS VTYKKRENIIFLKPTLPEESGKIELLPQVSIQEEEILPTETSHGSPGHLNLMKEVFLQ KIQGPTKWNKAKRHGESIKGKTESSKNTRSKLLNHHAWDYHYAAQIPKDMWKS KEKSPEIISIKQEDTILSLRPHGNSHSIGANEKQNWPQRETTWVKQGQTQRTCSQIP PVLKRHQRELSAFQSEQEATDYDDAITIETIEDPDIYSEDIKQGPRSFQQKTRHYFI AAVERLWDYGMSTSHVLRNRYQSDNVPQFKKVVFQEFTDGSFSQPLYRGELNEH LGLLGPYIRAEVEDNIMVTFKNQASRPYSFYSSLISYKEDQRGEEPRRNFVKPNET KIYFWKVQHHMAPTEDEFDCKAWAYFSDVDLERDMHSGLIGPLLICHANTLNPA HGRQVSVQEFALLFTIFDETKSWYFTENVKRNCKTPCNFQMEDPTLKENYRFHAI NGYVMDTLPGLVMAQDQRIRWYLLSMGNNENIQSIHFSGHVFTVRKKEEYKMA VYNLYPGVFETLEMIPSRAGIWRVECLIGEHLQAGMSTLFLVYSKQCQIPLGMAS GSIRDFQITASGHYGQWAPNLARLHYSGSINAWSTKEPFSWIKVDLLAPMIVHGIK TQGARQKFSSLYISQFIIMYSLDGKKWLSYQGNSTGTLMVFFGNVDSSGIKHNSF NPPIIARYIRLHPTHSSIRSTLRMELMGCDLNSCSIPLGMESKVISDTQITASSYFTN MFATWSPSQARLHLQGRTNAWRPQVNDPKQWLQVDLQKTMKVTGIITQGVKSL FTSMFVKEFLISSSQDGHHWTQILYNGKVKVFQGNQDSSTPMMNSLDPPLLTRYL RIHPQIWEHQIALRLEILGCEAQQQY | 5 |
| FVIII BDD variant (U.S. Pat. | MQIELSTCFFLCLLRFCFSATRRYYLGAVELSWDYMQSDLGELPVDARFPPRVPK SFPPNTSVVYKKTLFVEFTVHLFNIAKPRPPWMGLLGPTIQAEVYDTVVITLKNM ASHPVSLHAVGVSYWKASEGAEYDDQTSQREKEDDKVFPGGSHTYVWQVLKEN | 6 |

TABLE 1-continued

FVIII amino acid sequences

| Name (source) | Amino Acid Sequence | SEQ ID NO: |
|---|---|---|
| No. 7632921, SEQ ID NO: 3) | GPMASDPLCLTYSYLSHVDLVKDLNSGLIGALLVCREGSLAKEKTQTLHKFILLF AVFDEGKSWHSETKNSLMQDRDAASARAWPKMHTVNGYVNRSLPGLIGCHRKS VYWHVIGMTTPEVHSIFLEGHTFLVRNHRQASLEISPITFLTAQTLLMDLGQFLL FCHISSHQHDGMEAYVKVDSCPEEPQLRMKNNEEAEDYDDDLTDSEMDVVRFD DDNSPSFIQIRSVAKKHPKTWVHYIAAEEEDWDYAPLVLAPDDRSYKSQYLNNG PQRIGRKYKKVRFMAYTDETFKTREAIQHESGILGPLLYGEVGDTLLIIFKNQASR PYNIYPHGITDVRPLYSRRLPKGVKHLKDFPILPGEIFKYKWTVTVEDGPTKSDPR CLTRYYSSFVNMERDLASGLIGPLLICYKESVDQRGNQIMSDKRNVILFSVFDENR SWYLTENIQRFLPNPAGVQLEDPEFQASNIMHSINGYVFDSLQLSVCLHEVAYWY ILSIGAQTDFLSVFFSGYTFKHKMVYEDTLTLFPPSGETVFMSMENPGLWILGCHN SDFRNRGMTALLKVSSCDKNTGDYYEDSYEDISAYLLSKNNAIEPRSFSQNPPVL KRHQREITRTTLQSDQEEIDYDDTISVEMKKEDFDIYDEDENQSPRSFQKKTRHYF IAAVERLWDYGMSSSPHVLRNRAQSGSVPQFKKVVFQEFTDGSFTQPLYRGELNE HLGLLGPYIRAEVEDNIMVTFRNQASRPYSFYSSLISYEEDQRQGAEPRKNFVKPN ETKTYFWKVQHHMAPTKDEFDCKAWAYFSDVDLEKDVHSGLIGPLLVCHTNTL NPAHGRQVTVQEFALFFTIFDETKSWYFTENMERNCRAPCNIQMEDPTFKENYRF HAINGYIMDTLPGLVMAQDQRIRWYLLSMGSNENIHSIHFSGHVFTVRKKEEYK MALYNLYPGVFETVEMLPSKAGIWRVECLIGEHLHAGMSTLFLVYSNKCQTPLG MASGHIRDFQITASGQYGQWAPKLARLHYSGSINAWSTKEPFSWIKVDLLAPMII HGIKTQGARQKFSSLYISQFIIMYSLDGKKWQTYRGNSTGTLMVFFGNVDSSGIK HNIFNPPIIARYIRLHPTHYSIRSTLRMELMGCDLNSCSMPLGMESKAISDAQITASS YFTNMFATWSPSKARLHLQGRSNAWRPQVNNPKEWLQVDFQKTMKVTGVTTQ GVKSLLTSMYVKEFLISSSQDGHQWTLFFQNGKVKVFQGNQDSFTPVVNSLDPPL LTRYLRIHPQSWVHQIALRMEVLGCEAQDLY | |
| FVIII BDD-2 | ATRRYYLGAVELSWDYMQSDLGELPVDARFPPRVPKSFPFNTSVVYKKTLFVEFT VHLFNIAKPRPPWMGLLGPTIQAEVYDTVVITLKNMASHPVSLHAVGVSYWKE EGAEYDDQTSQREKEDDKVFPGGSHTYVWQVLKENGPMASDPLCLTYSYLSHV DLVKDLNSGLIGALLVCREGSLAKEKTQTLHKFILLFAVFDEGKSWHSETKNSLM QDRDAASARAWPKMHTVNGYVNRSLPGLIGCHRKSVYWHVIGMTTPEVHSIFL EGHTFLVRNHRQASLEISPITFLTAQTLLMDLGQFLLFCHISSHQHDGMEAYVKV DSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDE TFKTREAIQHESGILGPLLYGEVGDTLLIIFKNQASRPYNIYPHGITDVRPLYSRRLP KGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFK HKMVYEDTLTLFPPSGETVFMSMENPGLWILGCHNSDFRNRGMTALLKVSSCDK NTGDYYEDSYEDISAYLLSKNNAIEPRSFSQNPPVLKRHQREITRTTLQSDQEEIDY DDTISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIMVT FRNQASRPYSFYSSLISYEEDQRQGAEPRKNFVKPNETKTYFWKVQHHMAPTKD EFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQD QRIRWYLLSMGSNENIHSIHFSGHVFTVRKKEEYKMALYNLYPGVFETVEMLPSK AGIWRVECLIGEHLHAGMSTLFLVYSNKCQTPLGMASGHIRDFQITASGQYGQW APKLARLHYSGSINAWSTKEPFSWIKVDLLAPMIIHGIKTQGARQKFSSLYISQFII MYSLDGKKWQTYRGNSTGTLMVFFGNVDSSGIKHNIFNPPIIARYIRLHPTHYSIR STLRMELMGCDLNSCSMPLGMESKAISDAQITASSYFTNMFATWSPSKARLHLQ GRSNAWRPQVNNPKEWLQVDFQKTMKVTGVTTQGVKSLLTSMYVKEFLISSSQ DGHQWTLFFQNGKVKVFQGNQDSFTPVVNSLDPPLLTRYLRIHPQSWVHQIALR MEVLGCEAQDLY | 7 |
| FVIII BDD-3 (G1648) | ATRRYYLGAVELSWDYMQSDLGELPVDARFPPRVPKSFPFNTSVVYKKTLFVEFT VHLFNIAKPRPPWMGLLGPTIQAEVYDTVVITLKNMASHPVSLHAVGVSYWKAS EGAEYDDQTSQREKEDDKVFPGGSHTYVWQVLKENGPMASDPLCLTYSYLSHV DLVKDLNSGLIGALLVCREGSLAKEKTQTLHKFILLFAVFDEGKSWHSETKNSLM QDRDAASARAWPKMHTVNGYVNRSLPGLIGCHRKSVYWHVIGMTTPEVHSIFL EGHTFLVRNHRQASLEISPITFLTAQTLLMDLGQFLLFCHISSHQHDGMEAYVKV DSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDE TFKTREAIQHESGILGPLLYGEVGDTLLIIFKNQASRPYNIYPHGITDVRPLYSRRLP KGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFK HKMVYEDTLTLFPPSGETVFMSMENPGLWILGCHNSDFRNRGMTALLKVSSCDK NTGDYYEDSYEDISAYLLSKNNAIEPRSFSQNPPVLKRHQEITRTTLQSDQEEIDY DDTISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIMVT FRNQASRPYSFYSSLISYEEDQRQGAEPRKNFVKPNETKTYFWKVQHHMAPTKD EFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQD QRIRWYLLSMGSNENIHSIHFSGHVFTVRKKEEYKMALYNLYPGVFETVEMLPSK AGIWRVECLIGEHLHAGMSTLFLVYSNKCQTPLGMASGHIRDFQITASGQYGQW | 8 |

TABLE 1-continued

FVIII amino acid sequences

| Name (source) | Amino Acid Sequence | SEQ ID NO: |
|---|---|---|
| | APKLARLHYSGSINAWSTKEPFSWIKVDLLAPMIIHGIKTQGARQKFSSLYISQFII<br>MYSLDGKKWQTYRGNSTGTLMVFFGNVDSSGIKHNIFNPPIIARYIRLHPTHYSIR<br>STLRMELMGCDLNSCSMPLGMESKAISDAQITASSYFTNMFATWSPSKARLHLQ<br>GRSNAWRPQVNNPKEWLQVDFQKTMKVTGVTTQGVKSLLTSMYVKEFLISSSQ<br>DGHQWTLFFQNGKVKVFQGNQDSFTPVVNSLDPPLLTRYLRIHPQSWVHQIALR<br>MEVLGCEAQDLY | |
| FVIII BDD-4 | ATRRYYLGAVELSWDYMQSDLGELPVDARFPPRVPKSFPFNTSVVYKKTLFVEFT<br>VHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMGTTPEVHSIFL<br>EGHTFLVRNHRQASLEISPITFLTAQTLLMDLGQFLLFCHISSHQHDGMEAYVKV<br>DSCPEEPQLRMKNNEEAEDYDDDLTDSEMDVVRFDDDNSPSFIQIRSVAKKHPKT<br>WVHYIAAEEEDWDYAPLVLAPDDRSYKSQYLNNGPQRIGRKYKKVRFMAYTDE<br>TFKTREAIQHESGILGPLLYGEVGDTLLIIFKNQASRPYNIYPHGITDVRPLYSRRLP<br>KGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQL<br>EDPEFQASNIMHSINGYVFDSLQLSVCLHEVAYWYILSIGAQTDFLSVFFSGYTFK<br>HKMVYEDTLTLFPFSGETVFMSMENPGLWILGCHNSDFRNRGMTALLKVSSCDK<br>NTGDYYEDSYEDISAYLLSKNNAIEPRSFSQQSPRSFQKKTRHYFIAAVERLWDY<br>GMSSSPHVLRNRAQSGSVPQFKKVVFQEFTDGSFTQPLYRGELNEHLGLLGPYIR<br>AEVEDNIMVTFRNQASRPYSFYSSLISYEEDQRQGAEPRKNFVKPNETKTYFWKV<br>QHHMAPTKDEFDCKAWAYFSDVDLEKDVHSGLIGPLLVCHTNTLNPAHGRQVT<br>VQEFALFFTIFDETKSWYFTENMERNCRAPCNIQMEDPTFKENYRFHAINGYIMD<br>TLPGLVMAQDQRIRWYLLSMGSNENIHSIHFSGHVFTVRKKEEYKMALYNLYPG<br>VFETVEMLPSKAGIWRVECLIGEHLHAGMSTLFLVYSNKCQTPLGMASGHIRDFQ<br>ITASGQYGQWAPKLARLHYSGSINAWSTKEPFSWIKVDLLAPMIIHGIKTQGARQ<br>KFSSLYISQFIIMYSLDGKKWQTYRGNSTGTLMVFFGNVDSSGIKHNIFNPPIIARYI<br>RLHPTHYSIRSTLRMELMGCDLNSCSMPLGMESKAISDAQITASSYFTNMFATWS<br>PSKARLHLQGRSNAWRPQVNNPKEWLQVDFQKTMKVTGVTTQGVKSLLTSMY<br>VKEFLISSSQDGHQWTLFFQNGKVKVFQGNQDSFTPVVNSLDPPLLTRYLRIHPQS<br>WVHQIALRMEVLGCEAQDLY | 9 |
| FVIII BDD-5 | ATRRYYLGAVELSWDYMQSDLGELPVDARFPPRVPKSFPFNTSVVYKKTLFVEFT<br>VHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMGTTPEVHSIFL<br>EGHTFLVRNHRQASLEISPITFLTAQTLLMDLGQFLLFCHISSHQHDGMEAYVKV<br>DSCPEEPQLRMKNNEEAEDYDDDLTDSEMDVVRFDDDNSPSFIQIRSVAKKHPKT<br>WVHYIAAEEEDWDYAPLVLAPDDRSYKSQYLNNGPQRIGRKYKKVRFMAYTDE<br>TFKTREAIQHESGILGPLLYGEVGDTLLIIFKNQASRPYNIYPHGITDVRPLYSRRLP<br>KGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQL<br>EDPEFQASNIMHSINGYVFDSLQLSVCLHEVAYWYILSIGAQTDFLSVFFSGYTFK<br>HKMVYEDTLTLFPFSGETVFMSMENPGLWILGCHNSDFRNRGMTALLKVSSCDK<br>QSPRSFQKKTRHYFIAAVERLWDYGMSSSPHVLRNRAQSGSVPQFKKVVFQEFT<br>DGSFTQPLYRGELNEHLGLLGPYIRAEVEDNIMVTFRNQASRPYSFYSSLISYEED<br>QRQGAEPRKNFVKPNETKTYFWKVQHHMAPTKDEFDCKAWAYFSDVDLEKDV<br>HSGLIGPLLVCHTNTLNPAHGRQVTVQEFALFFTIFDETKSWYFTENMERNCRAP<br>CNIQMEDPTFKENYRFHAINGYIMDTLPGLVMAQDQRIRWYLLSMGSNENIHSIH<br>FSGHVFTVRKKEEYKMALYNLYPGVFETVEMLPSKAGIWRVECLIGEHLHAGMS<br>TLFLVYSNKCQTPLGMASGHIRDFQITASGQYGQWAPKLARLHYSGSINAWSTKE<br>PFSWIKVDLLAPMIIHGIKTQGARQKFSSLYISQFIIMYSLDGKKWQTYRGNSTGT<br>LMVFFGNVDSSGIKHNIFNPPIIARYIRLHPTHYSIRSTLRMELMGCDLNSCSMPLG<br>MESKAISDAQITASSYFTNMFATWSPSKARLHLQGRSNAWRPQVNNPKEWLQVD<br>FQKTMKVTGVTTQGVKSLLTSMYVKEFLISSSQDGHQWTLFFQNGKVKVFQGN<br>QDSFTPVVNSLDPPLLTRYLRIHPQSWVHQIALRMEVLGCEAQDLY | 10 |
| FVIII BDD-6 | ATRRYYLGAVELSWDYMQSDLGELPVDARFPPRVPKSFPFNTSVVYKKTLFVEFT<br>DHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMGTTPEVHSIFL<br>EGHTFLVRNHRQASLEISPITFLTAQTLLMDLGQFLLFCHISSHQHDGMEAYVKV<br>DSCPEEPQLRMKNNEEAEDYDDDLTDSEMDVVRFDDDNSPSFIQIRSVAKKHPKT<br>WVHYIAAEEEDWDYAPLVLAPDDRSYKSQYLNNGPQRIGRKYKKVRFMAYTDE<br>TFKTREAIQHESGILGPLLYGEVGDTLLIIFKNQASRPYNIYPHGITDVRPLYSRRLP<br>KGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQL<br>EDPEFQASNIMHSINGYVFDSLQLSVCLHEVAYWYILSIGAQTDFLSVFFSGYTFK<br>HKMVYEDTLTLFPFSGETVFMSMENPGLWILGCHNSDFRNRGMTALLKVSSCDK<br>NTGDYYEDSYEDISAYLLSKNNAIEPRSFSQNSRHPSTRQKQFNATTIPENDIEKTD | 11 |

TABLE 1-continued

FVIII amino acid sequences

| Name (source) | Amino Acid Sequence | SEQ ID NO: |
|---|---|---|
| | TISVEMKKEDFDIYDEDENQSPRSFQKKTRHYFIAAVERLWDYGMSSSPHVLRNR<br>AQSGSVPQFKKVVFQEFTDGSFTQPLYRGELNEHLGLLGPYIRAEVEDNIMVTFR<br>NQASRPYSFYSSLISYEEDQRQGAEPRKNFVKPNETKTYFWKVQHHMAPTKDEF<br>DCKAWAYFSDVDLEKDVHSGLIGPLLVCHTNTLNPAHGRQVTVQEFALFFTIFDE<br>TKSWYFTENMERNCRAPCNIQMEDPTFKENYRFHAINGYIMDTLPGLVMAQDQR<br>IRWYLLSMGSNENIHSIHFSGHVFTVRKKEEYKMALYNLYPGVFETVEMLPSKAG<br>IWRVECLIGEHLHAGMSTLFLVYSNKCQTPLGMASGHIRDFQITASGQYGQWAP<br>KLARLHYSGSINAWSTKEPFSWIKVDLLAPMIIHGIKTQGARQKFSSLYISQFIIMY<br>SLDGKKWQTYRGNSTGTLMVFFGNVDSSGIKHNIFNPPIIARYIRLHPTHYSIRSTL<br>RMELMGCDLNSCSMPLGMESKAISDAQITASSYFTNMFATWSPSKARLHLQGRS<br>NAWRPQVNNPKEWLQVDFQKTMKVTGVTTQGVKSLLTSMYVKEFLISSSQDGH<br>QWTLFFQNGKVKVFQGNQDSFTPVVNSLDPPLLTRYLRIHPQSWVHQIALRMEV<br>LGCEAQDLY | |
| FVIII<br>BDD-7 | ATRRYYLGAVELSWDYMQSDLGELPVDARFPPRVPKSFPFNTSVVYKKTLFVEFT<br>VHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMTTPEVHSIFL<br>EGHTFLVRNHRQASLEISPITFLTAQTLLMDLGQFLLFCHISSHQHDGMEAYVKV<br>DSCPEEPQLRMKNNEEAEDYDDDLTDSEMDVVRFDDDNSPSFIQIRSVAKKHPKT<br>WVHYIAAEEEDWDYAPLVLAPDDRSYKSQYLNNGPQRIGRKYKKVRFMAYTDE<br>TFKTREAIQHESGILGPLLYGEVGDTLLIIFKNQASRPYNIYPHGITDVRPLYSRRLP<br>KGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQL<br>EDPEFQASNIMHSINGYVFDSLQLSVCLHEVAYWYILSIGAQTDFLSVFFSGYTFK<br>HKMVYEDTLTLFPPSGETVFMSMENPGLWILGCHNSDFRNRGMTALLKVSSCDK<br>NTGDYYEDSYEDISAYLLSKNNAIEPRSFSQSPRSFQKKTRHYFIAAVERLWDYG<br>MSSSPHVLRNRAQSGSVPQFKKVVFQEFTDGSFTQPLYRGELNEHLGLLGPYIRA<br>EVEDNIMVTFRNQASRPYSFYSSLISYEEDQRQGAEPRKNFVKPNETKTYFWKVQ<br>HHMAPTKDEFDCKAWAYFSDVDLEKDVHSGLIGPLLVCHTNTLNPAHGRQVTV<br>QEFALFFTIFDETKSWYFTENMERNCRAPCNIQMEDPTFKENYRFHAINGYIMDTL<br>PGLVMAQDQRIRWYLLSMGSNENIHSIHFSGHVFTVRKKEEYKMALYNLYPGVF<br>ETVEMLPSKAGIWRVECLIGEHLHAGMSTLFLVYSNKCQTPLGMASGHIRDFQIT<br>ASGQYGQWAPKLARLHYSGSINAWSTKEPFSWIKVDLLAPMIIHGIKTQGARQKF<br>SSLYISQFIIMYSLDGKKWQTYRGNSTGTLMVFFGNVDSSGIKHNIFNPPIIARYIRL<br>HPTHYSIRSTLRMELMGCDLNSCSMPLGMESKAISDAQITASSYFTNMFATWSPS<br>KARLHLQGRSNAWRPQVNNPKEWLQVDFQKTMKVTGVTTQGVKSLLTSMYVK<br>EFLISSSQDGHQWTLFFQNGKVKVFQGNQDSFTPVVNSLDPPLLTRYLRIHPQSW<br>VHQIALRMEVLGCEAQDLY | 12 |
| FVIII<br>BDD-8<br>precursor<br>(U.S. Pat.<br>No.<br>6818439<br>SEQ ID<br>NO: 47) | MQIELSTCFFLCLLRFCFSATRRYYLGAVELSWDYMQSDLGELPVDARFPPRVPK<br>SFPFNTSVVYKKTLFVEFTDHLFNIAKPRPPWMGLLGPTIQAEVYDTVVITLKNM<br>ASHPVSLHAVGVSYWKASEGAEYDDQTSQREKEDDKVFPGGSHTYVWQVLKEN<br>GPMASDPLCLTYSYLSHVDLVKDLNSGLIGALLVCREGSLAKEKTQTLHKFILLF<br>AVFDEGKSWHSETKNSLMQDRDAASARAWPKMHTVNGYVNRSLPGLIGCHRKS<br>VYWHVIGMTTPEVHSIFLEGHTFLVRNHRQASLEISPITFLTAQTLLMDLGQFLL<br>FCHISSHQHDGMEAYVKVDSCPEEPQLRMKNNEEAEDYDDDLTDSEMDVVRFD<br>DDNSPSFIQIRSVAKKHPKTWVHYIAAEEEDWDYAPLVLAPDDRSYKSQYLNNG<br>PQRIGRKYKKVRFMAYTDETFKTREAIQHESGILGPLLYGEVGDTLLIIFKNQASR<br>PYNIYPHGITDVRPLYSRRLPKGVKHLKDFPILPGEIFKYKWTVTVEDGPTKSDPR<br>CLTRYYSSFVNMERDLASGLIGPLLICYKESVDQRGNQIMSDKRNVILFSVFDENR<br>SWYLTENIQRFLPNPAGVQLEDPEFQASNIMHSINGYVFDSLQLSVCLHEVAYWY<br>ILSIGAQTDFLSVFFSGYTFKHKMVYEDTLTLFPPSGETVFMSMENPGLWILGCHN<br>SDFRNRGMTALLKVSSCDKNTGDYYEDSYEDISAYLLSKNNAIEPRSFSQNPPVL<br>KRHQREITRTTLQSDQEEIDYDDTISVEMKKEDFDIYDEDENQSPRSFQKKTRHYF<br>IAAVERLWDYGMSSSPHVLRNRAQSGSVPQFKKVVFQEFTDGSFTQPLYRGELNE<br>HLGLLGPYIRAEVEDNIMVTFRNQASRPYSFYSSLISYEEDQRQGAEPRKNFVKPN<br>ETKTYFWKVQHHMAPTKDEFDCKAWAYFSDVDLEKDVHSGLIGPLLVCHTNTL<br>NPAHGRQVTVQEFALFFTIFDETKSWYFTENMERNCRAPCNIQMEDPTFKENYRF<br>HAINGYIMDTLPGLVMAQDQRIRWYLLSMGSNENIHSIHFSGHVFTVRKKEEYK<br>MALYNLYPGVFETVEMLPSKAGIWRVECLIGEHLHAGMSTLFLVYSNKCQTPLG<br>MASGHIRDFQITASGQYGQWAPKLARLHYSGSINAWSTKEPFSWIKVDLLAPMII<br>HGIKTQGARQKFSSLYISQFIIMYSLDGKKWQTYRGNSTGTLMVFFGNVDSSGIK<br>HNIFNPPIIARYIRLHPTHYSIRSTLRMELMGCDLNSCSMPLGMESKAISDAQITASS<br>YFTNMFATWSPSKARLHLQGRSNAWRPQVNNPKEWLQVDFQKTMKVTGVTTQ<br>GVKSLLTSMYVKEFLISSSQDGHQWTLFFQNGKVKVFQGNQDSFTPVVNSLDPPL<br>LTRYLRIHPQSWVHQIALRMEVLGCEAQDLY | 13 |
| FVIII<br>BDD-9<br>mature<br>(U.S. Pat.<br>No. | ATRRYYLGAVELSWDYMQSDLGELPVDARFPPRVPKSFPFNTSVVYKKTLFVEFT<br>DHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMTTPEVHSIFL | 14 |

TABLE 1-continued

FVIII amino acid sequences

| Name (source) | Amino Acid Sequence | SEQ ID NO: |
|---|---|---|
| 6818439) | EGHTFLVRNHRQASLEISPITFLTAQTLLMDLGQFLLFCHISSHQHDGMEAYVKV DSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDE TFKTREAIQHESGILGPLLYGEVGDTLLIIFKNQASRPYNIYPHGITDVRPLYSRRLP KGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFK HKMVYEDTLTLFPPSGETVFMSMENPGLWILGCHNSDFRNRGMTALLKVSSCDK NTGDYYEDSYEDISAYLLSKNNAIEPRSFSQNPPVLKRHQREITRTTLQSDQEEIDY DDTISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIMVT FRNQASRPYSFYSSLISYEEDQRQGAEPRKNFVKPNETKTYFWKVQHHMAPTKD EFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQD QRIRWYLLSMGSNENIHSIHFSGHVFTVRKKEEYKMALYNLYPGVFETVEMLPSK AGIWRVECLIGEHLHAGMSTLFLVYSNKCQTPLGMASGHIRDFQITASGQYGQW APKLARLHYSGSINAWSTKEPFSWIKVDLLAPMIIHGIKTQGARQKFSSLYISQFII MYSLDGKKWQTYRGNSTGTLMVFFGNVDSSGIKHNIFNPPIIARYIRLHPTHYSIR STLRMELMGCDLNSCSMPLGMESKAISDAQITASSYFTNMFATWSPSKARLHLQ GRSNAWRPQVNNPKEWLQVDFQKTMKVTGVTTQGVKSLLTSMYVKEFLISSSQ DGHQWTLFFQNGKVKVFQGNQDSFTPVVNSLDPPLLTRYLRIHPQSWVHQIALR MEVLGCEAQDLY | |
| FVIII BDD-10 | ATRRYYLGAVELSWDYMQSDLGELPVDARFPPRVPKSFPFNTSVVYKKTLFVEFT DHLFNIAKPRPPWMGLLGPTIQAEVYDTVVITLKNMASHPVSLHAVGVSYWKAS EGAEYDDQTSQREKEDDKVFPGGSHTYVWQVLKENGPMASDPLCLTYSYLSHV DLVKDLNSGLIGALLVCREGSLAKEKTQTLHKFILLFAVFDEGKSWHSETKNSLM QDRDAASARAWPKMHTVNGYVNRSLPGLIGCHRKSVYWHVIGMGTTPEVHSIFL EGHTFLVRNHRQASLEISPITFLTAQTLLMDLGQFLLFCHISSHQHDGMEAYVKV DSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDE TFKTREAIQHESGILGPLLYGEVGDTLLIIFKNQASRPYNIYPHGITDVRPLYSRRLP KGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFK HKMVYEDTLTLFPPSGETVFMSMENPGLWILGCHNSDFRNRGMTALLKVSSCDK NTGDYYEDSYEDISAYLLSKNNAIEPRSFSQNPPVLKRHQAEITRTTLQSDQEEIDY DDTISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIMVT FRNQASRPYSFYSSLISYEEDQRQGAEPRKNFVKPNETKTYFWKVQHHMAPTKD EFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQD QRIRWYLLSMGSNENIHSIHFSGHVFTVRKKEEYKMALYNLYPGVFETVEMLPSK AGIWRVECLIGEHLHAGMSTLFLVYSNKCQTPLGMASGHIRDFQITASGQYGQW APKLARLHYSGSINAWSTKEPFSWIKVDLLAPMIIHGIKTQGARQKFSSLYISQFII MYSLDGKKWQTYRGNSTGTLMVFFGNVDSSGIKHNIFNPPIIARYIRLHPTHYSIR STLRMELMGCDLNSCSMPLGMESKAISDAQITASSYFTNMFATWSPSKARLHLQ GRSNAWRPQVNNPKEWLQVDFQKTMKVTGVTTQGVKSLLTSMYVKEFLISSSQ DGHQWTLFFQNGKVKVFQGNQDSFTPVVNSLDPPLLTRYLRIHPQSWVHQIALR MEVLGCEAQDLY | 15 |
| FVIII BDD-11 | ATRATRRYYLGAVELSWDYMQSDLGELPVDARFPPRVPKSFPFNTSVVYKKTLF VEFTDHLFNIAKPRPPWMGLLGPTIQAEVYDTVVITLKNMASHPVSLHAVGVSY WKASEGAEYDDQTSQREKEDDKVFPGGSHTYVWQVLKENGPMASDPLCLTYSY LSHVDLVKDLNSGLIGALLVCREGSLAKEKTQTLHKFILLFAVFDEGKSWHSETK NSLMQDRDAASARAWPKMHTVNGYVNRSLPGLIGCHRKSVYWHVIGMGTTPEV HSIFLEGHTFLVRNHRQASLEISPITFLTAQTLLMDLGQFLLFCHISSHQHDGMEAY VKVDSCPEEPQLRMKNNEEAEDYDDDLTDSEMDVVRFDDDNSPSFIQIRSVAKK HPKTWVHYIAAEEEDWDYAPLVLAPDDRSYKSQYLNNGPQRIGRKYKKVRFMA YTDETFKTREAIQHESGILGPLLYGEVGDTLLIIFKNQASRPYNIYPHGITDVRPLYS RRLPKGVKHLKDFPILPGEIFKYKWTVTVEDGPTKSDPRCLTRYYSSFVNMERDL ASGLIGPLLICYKESVDQRGNQIMSDKRNVILFSVFDENRSWYLTENIQRFLPNPA GVQLEDPEFQASNIMHSINGYVFDSLQLSVCLHEVAYWYILSIGAQTDFLSVFFSG YTFKHKMVYEDTLTLFPPSGETVFMSMENPGLWILGCHNSDFRNRGMTALLKVS SCDKNTGDYYEDSYEDISAYLLSKNNAIEPRSFSQNPPVLKRHQAEITRTTLQSDQ EEIDYDDTISVEMKKEDFDIYDEDENQSPRSFQKKTRHYFIAAVERLWDYGMSSS PHVLRNRAQSGSVPQFKKVVFQEFTDGSFTQPLYRGELNEHLGLLGPYIRAEVED NIMVTFRNQASRPYSFYSSLISYEEDQRQGAEPRKNFVKPNETKTYFWKVQHHM APTKDEFDCKAWAYFSDVDLEKDVHSGLIGPLLVCHTNTLNPAHGRQVTVQEFA LFFTIFDETKSWYFTENMERNCRAPCNIQMEDPTFKENYRFHAINGYIMDTLPGLV MAQDQRIRWYLLSMGSNENIHSIHFSGHVFTVRKKEEYKMALYNLYPGVFETVE MLPSKAGIWRVECLIGEHLHAGMSTLFLVYSNKCQTPLGMASGHIRDFQITASGQ YGQWAPKLARLHYSGSINAWSTKEPFSWIKVDLLAPMIIHGIKTQGARQKFSSLYI SQFIIMYSLDGKKWQTYRGNSTGTLMVFFGNVDSSGIKHNIFNPPIIARYIRLHPTH | 16 |

TABLE 1-continued

FVIII amino acid sequences

| Name (source) | Amino Acid Sequence | SEQ ID NO: |
|---|---|---|
| | YSIRSTLRMELMGCDLNSCSMPLGMESKAISDAQITASSYFTNMFATWSPSKARL<br>HLQGRSNAWRPQVNNPKEWLQVDFQKTMKVTGVTTQGVKSLLTSMYVKEFLIS<br>SSQDGHQWTLFFQNGKVKVFQGNQDSFTPVVNSLDPPLLTRYLRIHPQSWVHQIA<br>LRMEVLGCEAQDLY | |
| FVIII BDD-12 | ATRRYYLGAVELSWDYMQSDLGELPVDARFPPRVPKSFPFNTSVVYKKTLFVEFT<br>DHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMGTTPEVHSIFL<br>EGHTFLVRNHRQASLEISPITFLTAQTLLMDLGQFLLFCHISSHQHDGMEAYVKV<br>DSCPEEPQLRMKNNEEAEDYDDDLTDSEMDVVRFDDDNSPSFIQIRSVAKKHPKT<br>WVHYIAAEEEDWDYAPLVLAPDDRSYKSQYLNNGPQRIGRKYKKVRFMAYTDE<br>TFKTREAIQHESGILGPLLYGEVGDTLLIIFKNQASRPYNIYPHGITDVRPLYSRRLP<br>KGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQL<br>EDPEFQASNIMHSINGYVFDSLQLSVCLHEVAYWYILSIGAQTDFLSVFFSGYTFK<br>HKMVYEDTLTLFPFSGETVFMSMENPGLWILGCHNSDFRNRGMTALLKVSSCDK<br>NTGDYYEDSYEDISAYLLSKNNAIEPRSFSQNPPVLKRHQAEITRTTLQSDQEEIDY<br>DDTISVEMKKEDFDIFDEDENQSPRSFQKKTRHYFIAAVERLWDYGMSSSPHVLR<br>NRAQSGSVPQFKKVVFQEFTDGSFTQPLYRGELNEHLGLLGPYIRAEVEDNIMVT<br>FRNQASRPYSFYSSLISYEEDQRQGAEPRKNFVKPNETKTYFWKVQHHMAPTKD<br>EFDCKAWAYFSDVDLEKDVHSGLIGPLLVCHTNTLNPAHGRQVTVQEFALFFTIF<br>DETKSWYFTENMERNCRAPCNIQMEDPTFKENYRFHAINGYIMDTLPGLVMAQD<br>QRIRWYLLSMGSNENIHSIHFSGHVFTVRKKEEYKMALYNLYPGVFETVEMLPSK<br>AGIWRVECLIGEHLHAGMSTLFLVYSNKCQTPLGMASGHIRDFQITASGQYGQW<br>APKLARLHYSGSINAWSTKEPFSWIKVDLLAPMIIHGIKTQGARQKFSSLYISQFII<br>MYSLDGKKWQTYRGNSTGTLMVFFGNVDSSGIKHNIFNPPIIARYIRLHPTHYSIR<br>STLRMELMGCDLNSCSMPLGMESKAISDAQITASSYFTNMFATWSPSKARLHLQ<br>GRSNAWRPQVNNPKEWLQVDFQKTMKVTGVTTQGVKSLLTSMYVKEFLISSSQ<br>DGHQWTLFFQNGKVKVFQGNQDSFTPVVNSLDPPLLTRYLRIHPQSWVHQIALR<br>MEVLGCEAQDLY | 17 |
| FVIII BDD-13 | ATRRYYLGAVELSWDYMQSDLGELPVDARFPPRVPKSFPFNTSVVYKKTLFVEFT<br>DHLFNIAKPRPPWMGLLGPTIQAEVYDTVVITLKNMASHPVSLHAVGVSYWKAS<br>EGAEYDDQTSQREKEDDKVFPGGSHTYVWQVLKENGPMASDPLCLTYSYLSHV<br>DLVKDLNSGLIGALLVCREGSLAKEKTQTLHKFILLFAVFDEGKSWHSETKNSLM<br>QDRDAASARAWPKMHTVNGYVNRSLPGLIGCHRKSVYWHVIGMGTTPEVHSIFL<br>EGHTFLVRNHRQASLEISPITFLTAQTLLMDLGQFLLFCHISSHQHDGMEAYVKV<br>DSCPEEPQLRMKNNEEAEDYDDDLTDSEMDVVRFDDDNSPSFIQIRSVAKKHPKT<br>WVHYIAAEEEDWDYAPLVLAPDDRSYKSQYLNNGPQRIGRKYKKVRFMAYTDE<br>TFKTREAIQHESGILGPLLYGEVGDTLLIIFKNQASRPYNIYPHGITDVRPLYSRRLP<br>KGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQL<br>EDPEFQASNIMHSINGYVFDSLQLSVCLHEVAYWYILSIGAQTDFLSVFFSGYTFK<br>HKMVYEDTLTLFPFSGETVFMSMENPGLWILGCHNSDFRNRGMTALLKVSSCDK<br>NTGDYYEDSYEDISAYLLSKNNAIEPRSFSQNPPVLKRHQREITRTTLQSDQEEIDY<br>DDTISVEMKKEDFDIFDEDENQSPRSFQKKTRHYFIAAVERLWDYGMSSSPHVLR<br>NRAQSGSVPQFKKVVFQEFTDGSFTQPLYRGELNEHLGLLGPYIRAEVEDNIMVT<br>FRNQASRPYSFYSSLISYEEDQRQGAEPRKNFVKPNETKTYFWKVQHHMAPTKD<br>EFDCKAWAYFSDVDLEKDVHSGLIGPLLVCHTNTLNPAHGRQVTVQEFALFFTIF<br>DETKSWYFTENMERNCRAPCNIQMEDPTFKENYRFHAINGYIMDTLPGLVMAQD<br>QRIRWYLLSMGSNENIHSIHFSGHVFTVRKKEEYKMALYNLYPGVFETVEMLPSK<br>AGIWRVECLIGEHLHAGMSTLFLVYSNKCQTPLGMASGHIRDFQITASGQYGQW<br>APKLARLHYSGSINAWSTKEPFSWIKVDLLAPMIIHGIKTQGARQKFSSLYISQFII<br>MYSLDGKKWQTYRGNSTGTLMVFFGNVDSSGIKHNIFNPPIIARYIRLHPTHYSIR<br>STLRMELMGCDLNSCSMPLGMESKAISDAQITASSYFTNMFATWSPSKARLHLQ<br>GRSNAWRPQVNNPKEWLQVDFQKTMKVTGVTTQGVKSLLTSMYVKEFLISSSQ<br>DGHQWTLFFQNGKVKVFQGNQDSFTPVVNSLDPPLLTRYLRIHPQSWVHQIALR<br>MEVLGCEAQDLY | 18 |

The present invention also contemplates CFXTEN comprising FVIII with various amino acid deletions, insertions and substitutions made in the FVIII sequences of Table 1 that retain procoagulant activity. Examples of conservative substitutions for amino acids in polypeptide sequences are shown in Table 2. In embodiments of the CFXTEN in which the sequence identity of the FVIII is less than 100% compared to a specific sequence disclosed herein, the invention contemplates substitution of any of the other 19 natural L-amino acids for a given amino acid residue of the given FVIII, which may be at any position within the sequence of the FVIII, including adjacent amino acid residues. If any one substitution results in an undesirable change in procoagulant activity, then one of the alternative amino acids can be employed and the construct protein evaluated by the methods described herein (e.g., the assays of Table 49), or using any of the techniques and guidelines for conservative and non-conservative mutations set forth, for instance, in U.S. Pat. No. 5,364,934, the content of which is incorporated by reference in its entirety, or using methods generally known in the art. In a preferred substitution, the FVIII component of the CFXTEN embodiments is modified by replacing the R1648 residue (numbered relative to the native mature form of FVIII) with glycine or alanine to prevent proteolytic processing to the heterodimer form. In another substitution, the FVIII component of the CFXTEN embodiments is modified by replacing the Y1680 residue (numbered relative to the native mature form of FVIII) with phenylalanine. In another embodiment, the FVIII component of the CFXTEN embodiments is modified by replacing the Y1680 residue (numbered relative to the native mature form of FVIII) with phenylalanine and the R1648 residue (numbered relative to the native mature form of FVIII) with glycine or alanine.

In one embodiment, the FVIII of the fusion protein composition has one or more amino acid substitutions designed to reduce the binding of FVIII inhibitors at epitopes recognized by the antibodies of Table 9, including but not limited to substitutions at Lys(377), Lys(466), Lys(380), Ser(488), Arg(489), Arg(490), Leu(491), Lys(493), Lys(496), His(497), Lys(499), Lys(512), Lys(523), Lys(556), Met (2199), Phe(2200), Leu(2252), Val(2223), and Lys(2227). In addition, variants can include, for instance, polypeptides wherein one or more amino acid residues are added or deleted at or near the N- or C-terminus of the full-length native amino acid sequence or of a domain of a FVIII so long as the variant retains some if not all of the procoagulant activity of the native peptide. The resulting FVIII sequences that retain at least a portion (e.g., at least 10%, 20%, 30%, 40%, 50%, 60%, 70%, 80%, 90%, or at least 95% or more) of the procoagulant activity in comparison to native circulating FVIII are considered useful for the fusion protein compositions of this invention. Examples of FVIII variants are known in the art, including those described in U.S. Pat. Nos. 6,316,226; 6,818,439; 7,632,921; 20080227691, which are incorporated herein by reference. In one embodiment, a FVIII sequence variant has an aspartic acid substituted for valine at amino acid position 75 (numbered relative to the native mature form of FVIII).

TABLE 2

Exemplary conservative amino acid substitutions

| Original Residue | Exemplary Substitutions |
| --- | --- |
| Ala (A) | val; leu; ile |
| Arg (R) | lys; gln; asn |
| Asn (N) | gin; his; lys; arg |
| Asp (D) | Glu |
| Cys (C) | Ser |
| Gln (Q) | Asn |
| Glu (E) | Asp |
| Gly (G) | Pro |
| His (H) | asn: gin: lys: arg |
| Ile (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | Gly |
| Ser (S) | Thr |
| Thr (T) | Ser |
| Trp (W) | Tyr |
| Tyr (Y) | Trp: phe: thr: ser |
| Val (V) | Ile; leu; met; phe; ala; norleucine |

III). Extended Recombinant Polypeptides

In one aspect, the invention provides XTEN polypeptide compositions that are useful as fusion protein partner(s) to link to and/or incorporate within a FVIII polypeptide, resulting in a CFXTEN fusion protein. XTEN are generally polypeptides with non-naturally occurring, substantially non-repetitive sequences having a low degree of or no secondary or tertiary structure under physiologic conditions. XTEN typically have from about 36 to about 3000 amino acids of which the majority or the entirety are small hydrophilic amino acids. As used herein, "XTEN" specifically excludes whole antibodies or antibody fragments (e.g. single-chain antibodies and Fc fragments). XTEN polypeptides have utility as a fusion protein partners in that they serve various roles, conferring certain desirable pharmacokinetic, physicochemical, pharmacologic, and pharmaceutical properties when linked to a FVIII protein to a create a CFXTEN fusion protein. Such CFXTEN fusion protein compositions have enhanced properties compared to the corresponding FVIII not linked to XTEN, making them useful in the treatment of certain conditions related to FVIII deficiencies or bleeding disorders, as more fully described below.

The selection criteria for the XTEN to be fused to the FVIII proteins used to create the inventive fusion proteins compositions generally relate to attributes of physical/chemical properties and conformational structure of the XTEN that is, in turn, used to confer enhanced pharmaceutical, pharmacologic, and pharmacokinetic properties to the FVIII fusion proteins compositions. The unstructured characteristic and physical/chemical properties of the XTEN result, in part, from the overall amino acid composition disproportionately limited to 4-6 hydrophilic amino acids, the linking of the amino acids in a quantifiable non-repetitive design, and the length of the XTEN polypeptide. In an advantageous feature common to XTEN but uncommon to polypeptides, the properties of XTEN disclosed herein are not tied to absolute primary amino acid sequences, as evidenced by the diversity of the exemplary sequences of Table 4 that, within varying ranges of length, possess similar properties, many of which are documented in the Examples. The XTEN of the present invention may exhibit one or more, or all of the following advantageous properties: unstructured conformation, conformational flexibility, enhanced aqueous solubility, high degree of protease resistance, low immunogenicity, low binding to mammalian receptors, a defined degree of charge, and increased hydrodynamic (or Stokes) radii; properties that can make them particularly useful as fusion protein partners. Non-limiting examples of the enhanced properties that XTEN confer on the fusion proteins comprising FVIII fused to XTEN, compared to FVIII not linked to XTEN, include increases in the overall solubility and/or metabolic stability, reduced susceptibility to proteolysis, reduced immunogenicity, reduced rate of absorption when administered subcutaneously or intramuscularly, reduced binding to FVIII clearance receptors, reduced reactivity to anti-payload antibodies, enhanced interactions with substrate, and/or enhanced pharmacokinetic properties when administered to a subject. The enhanced pharmacokinetic properties of the CFXTEN compositions compared to FVIII not linked to XTEN include longer terminal half-life (e.g., two-fold, three-fold, four-fold or more), increased area under the curve (AUC) (e.g., 25%, 50%, 100% or more), lower volume of distribution, and enhanced absorption after subcutaneous or intramuscular injection (an advantage compared to commercially-available forms of FVIII that must be administered intravenously). In addition, it is believed that the CFXTEN compositions comprising cleavage sequences (described more fully, below) permit sustained release of biologically active FVIII, such that the administered CFXTEN acts as a depot. It is specifically contemplated that the inventive CFXTEN fusion proteins can exhibit one or more or any combination of the improved properties disclosed herein. As a result of these enhanced properties, it is believed that CFXTEN compositions permit less frequent dosing compared to FVIII not linked to XTEN when administered at comparable dosages. Such CFXTEN fusion protein compositions have utility to treat certain factor VIII-related conditions, as described herein.

A variety of methods and assays are known in the art for determining the physical/chemical properties of proteins such as the CFXTEN compositions comprising XTEN. Such properties include but are not limited to secondary or tertiary structure, solubility, protein aggregation, stability, absolute and apparent molecular weight, purity and uniformity, melting properties, contamination and water content. Methods to assay these properties include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau, et al., Prot Expr and Purif (2006) 48, 1-13.

The XTEN component(s) of the CFXTEN are designed to behave like denatured peptide sequences under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the invention provides XTEN sequences that, under physiologic conditions, are largely devoid of secondary structure. In other cases, the XTEN sequences are substantially devoid of secondary structure under physiologic conditions such that the XTEN can adopt random coil conformation. "Largely devoid," as used in this context, means that at least 50% of the XTEN amino acid residues of the XTEN sequence do not contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the methods described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra, as does the lack of these structure elements. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In one embodiment, the XTEN sequences used in the subject fusion protein compositions have an alpha-helix percentage ranging from 0% to less than about 5% as determined by the Chou-Fasman algorithm. In another embodiment, the XTEN sequences of the fusion protein compositions have a beta-sheet percentage ranging from 0% to less than about 5% as determined by the Chou-Fasman algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm. In some embodiments, the XTEN sequences of the fusion protein compositions have an alpha-helix percentage less than about 2% and a beta-sheet percentage less than about 2%. The XTEN sequences of the fusion protein compositions have a high degree of random coil percentage, as determined by the GOR algorithm. In some embodiments, an XTEN sequence have at least about 80%, at least about 90%, at least about 91%, at least about 92%, at least about 93%, at least about 94%, at least about 95%, at least about 96%, at least about 97%, at least about 98%, and most preferably at least about 99% random coil, as determined by the GOR algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm and at least about 90% random coil, as determined by the GOR algorithm. In other embodiments, the XTEN sequences of the fusion protein compositions have an alpha-helix percentage less than about 2% and a beta-sheet percentage less than about 2% at least about 90% random coil, as determined by the GOR algorithm.

1. Non-Repetitive Sequences

It is contemplated that the XTEN sequences of the CFXTEN embodiments are substantially non-repetitive. In general, repetitive amino acid sequences have a tendency to aggregate or form higher order structures, as exemplified by natural repetitive sequences such as collagens and leucine zippers. These repetitive amino acids may also tend to form contacts resulting in crystalline or pseudocrystalline structures. In contrast, the low tendency of non-repetitive sequences to aggregate enables the design of long-sequence XTENs with a relatively low frequency of charged amino acids that would otherwise be likely to aggregate if the sequences were repetitive. The non-repetitiveness of a subject XTEN can be observed by assessing one or more of the following features. In one embodiment, a "substantially non-repetitive" XTEN sequence has about 36, or at least 72, or at least 96, or at least 144, or at least 288, or at least 400, or at least 500, or at least 600, or at least 700, or at least 800, or at least 864, or at least 900, or at least 1000, or at least 2000, to about 3000 or more amino acid residues, or has a length ranging from about 36 to about 3000, about 100 to about 500, about 500 to about 1000, about 1000 to about 3000 amino acids and residues, in which no three contiguous amino acids in the sequence are identical amino acid types unless the amino acid is serine, in which case no more than three contiguous amino acids are serine residues. In another embodiment, as described more fully below, a "substantially non-repetitive" XTEN sequence comprises motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif.

Figure 27:
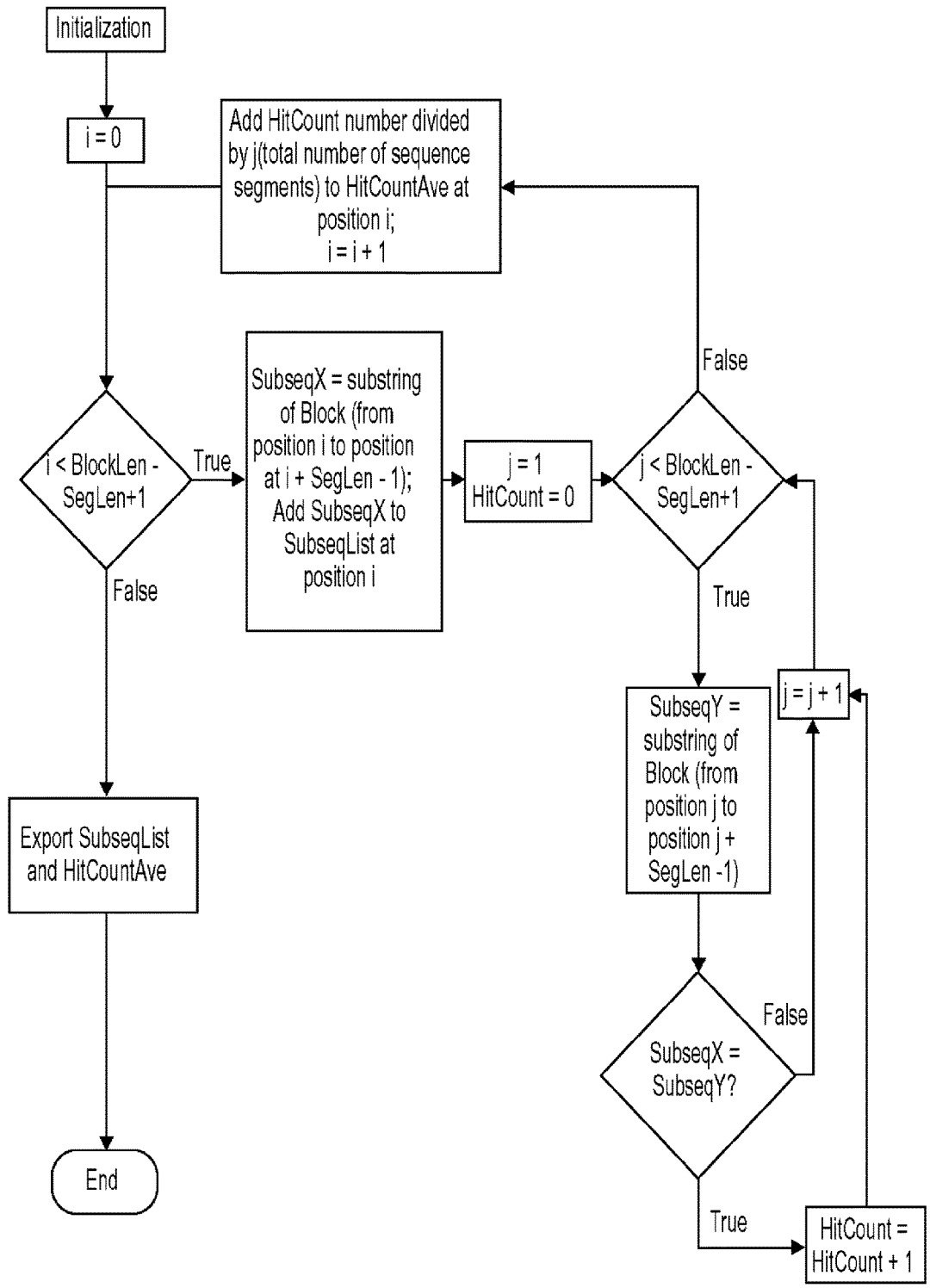
FIG. 27 is a schematic of the logic flow chart of the algorithm SegScore. In the figure the following legend applies: i, j—counters used in the control loops that run through the entire sequence; HitCount—this variable is a counter that keeps track of how many times a subsequence encounters an identical subsequence in a block; SubSeqX—this variable holds the subsequence that is being checked for redundancy; SubSeqY—this variable holds the subsequence that the SubSeqX is checked against; BlockLen—this variable holds the user determined length of the block; SegLen—this variable holds the length of a segment. The program is hardcoded to generate scores for subsequences of lengths 3, 4, 5, 6, 7, 8, 9, and 10; Block—this variable holds a string of length BlockLen. The string is composed of letters from an input XTEN sequence and is determined by the position of the i counter; SubSeqList—this is a list that holds all of the generated subsequence scores.
Figure 28:
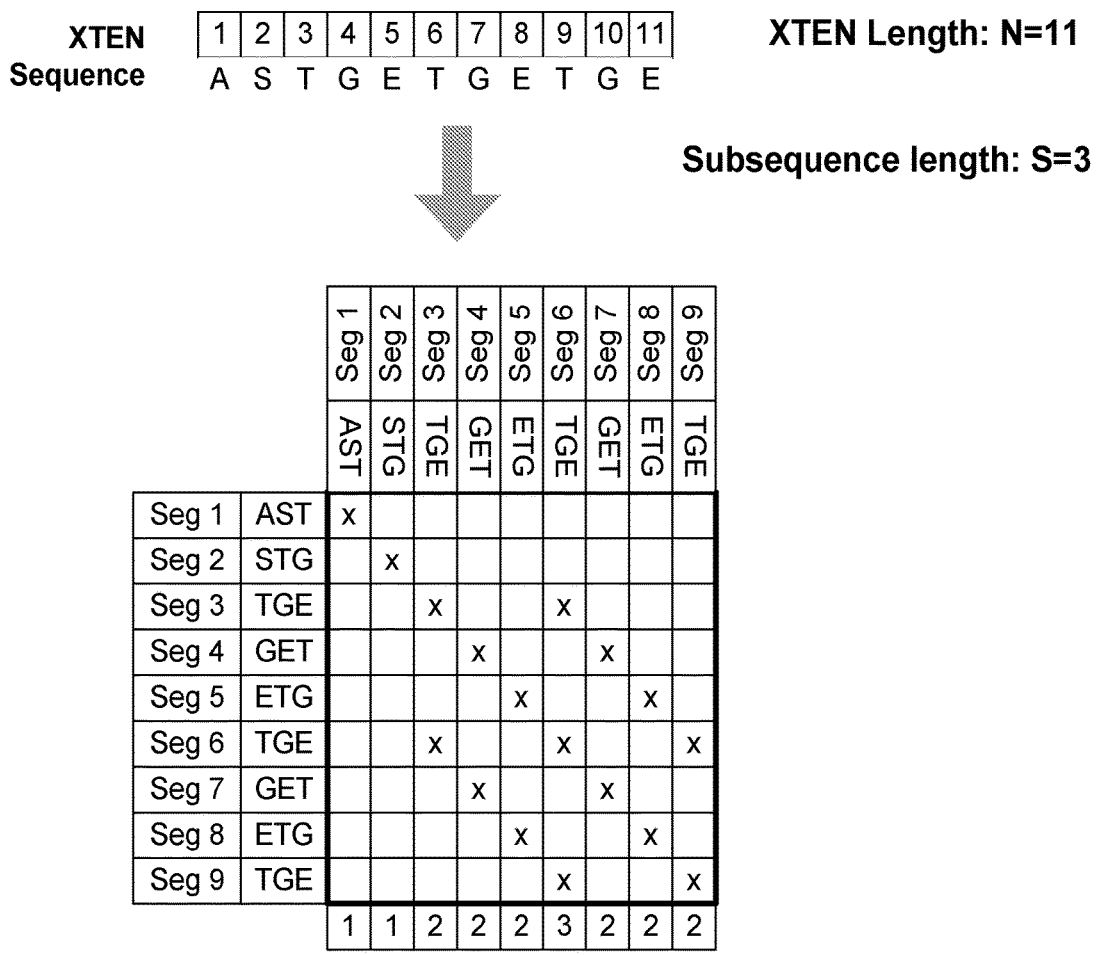
FIG. 28 depicts the application of the algorithm SegScore to a hypothetical XTEN of 11 amino acids (SEQ ID NO: 1591) in order to determine the repetitiveness. An XTEN sequence consisting of N amino acids is divided into N-S+1 subsequences of length S(S=3 in this case). A pair-wise comparison of all subsequences is performed and the average number of identical subsequences is calculated to result in the subsequence score of 1.89.

The degree of repetitiveness of a polypeptide or a gene can be measured by computer programs or algorithms or by other means known in the art. According to the current invention, algorithms to be used in calculating the degree of repetitiveness of a particular polypeptide, such as an XTEN, are disclosed herein, and examples of sequences analyzed by algorithms are provided (see Examples, below). In one aspect, the repetitiveness of a polypeptide of a predetermined length can be calculated (hereinafter "subsequence score") according to the formula given by Equation 1:

$$\text{Subsequence score} = \frac{\sum_{i=1}^{m} \text{Count}_i}{m} \qquad \text{I}$$

wherein: m=(amino acid length of polypeptide)-(amino acid length of subsequence)+1; and $\text{Count}_i$=cumulative number of occurrences of each unique subsequence within $\text{sequence}_i$ An algorithm termed "SegScore" was developed to apply the foregoing equation to quantitate repetitiveness of polypeptides, such as an XTEN, providing the subsequence score wherein sequences of a predetermined amino acid length "n" are analyzed for repetitiveness by determining the number of times (a "count") a unique subsequence of length "s" appears in the set length, divided by the absolute number of subsequences within the predetermined length of the sequence. FIG. 27 depicts a logic flowchart of the SegScore algorithm, while FIG. 28 portrays a schematic of how a subsequence score is derived for a fictitious XTEN with 11 amino acids and a subsequence length of 3 amino acid residues. For example, a predetermined polypeptide length of 200 amino acid residues has 192 overlapping 9-amino acid subsequences and 198 3-mer subsequences, but the subsequence score of any given polypeptide will depend on the absolute number of unique subsequences and how frequently each unique subsequence (meaning a different amino acid sequence) appears in the predetermined length of the sequence.

In the context of the present invention, "subsequence score" means the sum of occurrences of each unique 3-mer frame across 200 consecutive amino acids of the cumulative XTEN polypeptide divided by the absolute number of unique 3-mer subsequences within the 200 amino acid sequence. Examples of such subsequence scores derived from 200 consecutive amino acids of repetitive and non-repetitive polypeptides are presented in Example 45. In one embodiment, the invention provides a CFXTEN comprising one XTEN in which the XTEN has a subsequence score less than 12, more preferably less than 10, more preferably less than 9, more preferably less than 8, more preferably less than 7, more preferably less than 6, and most preferably less than 5. In another embodiment, the invention provides CFXTEN comprising at least two to about six XTEN in which 200 amino acids of the XTEN have a subsequence score of less than 10, more preferably less than 9, more preferably less than 8, more preferably less than 7, more preferably less than 6, and most preferably less than 5. In the embodiments of the CFXTEN fusion protein compositions described herein, an XTEN component of a fusion protein with a subsequence score of 10 or less (i.e., 9, 8, 7, etc.) is also substantially non-repetitive.

It is believed that the non-repetitive characteristic of XTEN of the present invention together with the particular types of amino acids that predominate in the XTEN, rather than the absolute primary sequence, confers many of the enhanced physicochemical and biological properties of the CFXTEN fusion proteins. These enhanced properties include a higher degree of expression of the fusion protein in the host cell, greater genetic stability of the gene encoding XTEN, a greater degree of solubility, less tendency to aggregate, and enhanced pharmacokinetics of the resulting CFXTEN compared to fusion proteins comprising polypeptides having repetitive sequences. These enhanced properties permit more efficient manufacturing, lower cost of goods, and facilitate the formulation of XTEN-comprising pharmaceutical preparations containing extremely high protein concentrations, in some cases exceeding 100 mg/ml. Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to only three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345:1365-71; Hsu, C. T., et al. (2000) Cancer Res, 60:3701-5); Bachmann M F, et al. Eur J. Immunol. (1995) 25(12): 3445-3451).

2. Exemplary Sequence Motifs

The present invention encompasses XTEN used as fusion partners that comprise multiple units of shorter sequences, or motifs, in which the amino acid sequences of the motifs are non-repetitive. The non-repetitive property is met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is designed to render the sequence substantially non-repetitive.

In one embodiment, an XTEN has a substantially non-repetitive sequence of greater than about 36 to about 3000, or about 100 to about 2000, or about 144 to about 1000 amino acid residues, or even longer wherein at least about 80%, or at least about 85%, or at least about 90%, or at least about 95%, or at least about 97%, or about 100% of the XTEN sequence consists of non-overlapping sequence motifs, and wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence consists of non-overlapping sequence motifs wherein each of the motifs has 12 amino acid residues. In these embodiments, it is preferred that the sequence motifs are composed of substantially (e.g., 90% or more) or exclusively small hydrophilic amino acids, such that the overall sequence has an unstructured, flexible characteristic. Examples of amino acids that are included in XTEN are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with the enhanced characteristics disclosed herein mainly or exclusively include glycine (G), alanine (A), serine (S), threonine (T), glutamate (E) and proline (P) residues wherein the sequences are designed to be substantially non-repetitive. In one embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 36 to about 3000, or about 100 to about 2000, or about 144 to about 1000 amino acid residues in length. In some embodiment, an XTEN sequence is made of 4, 5, or 6 types of amino acids selected from the group consisting of glycine (G), alanine (A), serine (S), threonine (T), glutamate (E) or proline (P). In some embodiments, XTEN have sequences of greater than about 36 to about 1000, or about 100 to about 2000, or about 400 to about 3000 amino acid residues wherein at least about 80% of the sequence consists of non-overlapping sequence motifs wherein each of the motifs has 9 to 36 amino acid residues and wherein at least 90%, or at least 91%, or at least 92%, or at least 93%, or at least 94%, or at least 95%, or at least 96%, or at least 97%, or 100% of each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 40%, or about 30%, or 25%, or about 17%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 40%, or 30%, or about 25%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P).

In still other embodiments, XTENs comprise substantially non-repetitive sequences of greater than about 36 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of four to six types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. The foregoing embodiments are examples of substantially non-repetitive XTEN sequences. Additional examples are detailed below.

In some embodiments, the invention provides CFXTEN compositions comprising one, or two, or three, or four, five, six or more non-repetitive XTEN sequence(s) of about 36 to about 1000 amino acid residues, or cumulatively about 100 to about 3000 amino acid residues wherein at least about 80%, or at least about 90%, or about 91%, or about 92%, or about 93%, or about 94%, or about 95%, or about 96%, or about 97%, or about 98%, or about 99% to about 100% of the sequence consists of multiple units of four or more non-overlapping sequence motifs selected from the amino acid sequences of Table 3, wherein the overall sequence remains substantially non-repetitive. In some embodiments, the XTEN comprises non-overlapping sequence motifs in which about 80%, or at least about 85%, or at least about 90%, or about 91%, or about 92%, or about 93%, or about 94%, or about 95%, or about 96%, or about 97%, or about 98%, or about 99% or about 100% of the sequence consists of multiple units of non-overlapping sequences selected from a single motif family selected from Table 3, resulting in a family sequence. As used herein, "family" means that the XTEN has motifs selected only from a single motif category from Table 3; i.e., AD, AE, AF, AG, AM, AQ, BC, or BD XTEN, and that any other amino acids in the XTEN not from a family motif are selected to achieve a needed property, such as to permit incorporation of a restriction site by the encoding nucleotides, incorporation of a cleavage sequence, or to achieve a better linkage to a FVIII coagulation factor component of the CFXTEN. In some embodiments of XTEN families, an XTEN sequence comprises multiple units of non-overlapping sequence motifs of the AD motif family, or of the AE motif family, or of the AF motif family, or of the AG motif family, or of the AM motif family, or of the AQ motif family, or of the BC family, or of the BD family, with the resulting XTEN exhibiting the range of homology described above. In other embodiments, the XTEN comprises multiple units of motif sequences from two or more of the motif families of Table 3. These sequences can be selected to achieve desired physical/chemical characteristics, including such properties as net charge, hydrophilicity, lack of secondary structure, or lack of repetitiveness that are conferred by the amino acid composition of the motifs, described more fully below. In the embodiments hereinabove described in this paragraph, the motifs incorporated into the XTEN can be selected and assembled using the methods described herein to achieve an XTEN of about 36 to about 3000 amino acid residues.

TABLE 3

XTEN Sequence Motifs of 12 Amino Acids and Motif Families

| Motif Family | MOTIF SEQUENCE | SEQ ID NO: |
|---|---|---|
| AD | GESPGGSSGSES | 19 |
| AD | GSEGSSGPGESS | 20 |
| AD | GSSESGSSEGGP | 21 |
| AD | GSGGEPSESGSS | 22 |
| AE, AM | GSPAGSPTSTEE | 23 |
| AE, AM, AQ | GSEPATSGSETP | 24 |
| AE, AM, AQ | GTSESATPESGP | 25 |
| AE, AM, AQ | GTSTEPSEGSAP | 26 |
| AF, AM | GSTSESPSGTAP | 27 |
| AF, AM | GTSTPESGSASP | 28 |
| AF, AM | GTSPSGESSTAP | 29 |
| AF, AM | GSTSSTAESPGP | 30 |
| AG, AM | GTPGSGTASSSP | 31 |
| AG, AM | GSSTPSGATGSP | 32 |
| AG, AM | GSSPSASTGTGP | 33 |
| AG, AM | GASPGTSSTGSP | 34 |
| AQ | GEPAGSPTSTSE | 35 |
| AQ | GTGEPSSTPASE | 36 |
| AQ | GSGPSTESAPTE | 37 |

TABLE 3-continued

XTEN Sequence Motifs of 12 Amino Acids and Motif Families

| Motif Family | MOTIF SEQUENCE | SEQ ID NO: |
|---|---|---|
| AQ | GSETPSGPSETA | 38 |
| AQ | GPSETSTSEPGA | 39 |
| AQ | GSPSEPTEGTSA | 40 |
| BC | GSGASEPTSTEP | 41 |
| BC | GSEPATSGTEPS | 42 |
| BC | GTSEPSTSEPGA | 43 |
| BC | GTSTEPSEPGSA | 44 |
| BD | GSTAGSETSTEA | 45 |
| BD | GSETATSGSETA | 46 |
| BD | GTSESATSESGA | 47 |
| BD | GTSTEASEGSAS | 48 |

* Denotes individual motif sequences that, when used together in various permutations, results in a "family sequence"

In some embodiments of XTEN families, an XTEN sequence comprises multiple units of non-overlapping sequence motifs of the AD motif family, the AE motif family, or the AF motif family, or the AG motif family, or the AM motif family, or the AQ motif family, or the BC family, or the BD family, with the resulting XTEN exhibiting the range of homology described above. In other embodiments, the XTEN comprises multiple units of motif sequences from two or more of the motif families of Table 3, selected to achieve desired physicochemical characteristics, including such properties as net charge, lack of secondary structure, or lack of repetitiveness that may be conferred by the amino acid composition of the motifs, described more fully below. In the embodiments hereinabove described in this paragraph, the motifs or portions of the motifs incorporated into the XTEN can be selected and assembled using the methods described herein to achieve an XTEN of about 36, about 42, about 72, about 144, about 288, about 576, about 864, about 1000, about 2000 to about 3000 amino acid residues, or any intermediate length. Non-limiting examples of XTEN family sequences useful for incorporation into the subject CFX-TEN are presented in Table 4. It is intended that a specified sequence mentioned relative to Table 4 has that sequence set forth in Table 4, while a generalized reference to an AE144 sequence, for example, is intended to encompass any AE sequence having 144 amino acid residues; e.g., AE144_1A, AE144_2A, etc., or a generalized reference to an AG144 sequence, for example, is intended to encompass any AG sequence having 144 amino acid residues, e.g., AG144_1, AG144_2, AG144_A, AG144_B, AG144_C, etc.

TABLE 4

XTEN Polypeptides

| XTEN Name | Amino Acid Sequence | SEQ ID NO: |
|---|---|---|
| AE42 | GAPGSPAGSPTSTEEGTSESATPESGPGSEPATSGSETPASS | 49 |
| AE42_1 | TEPSEGSAPGSPAGSPTSTEEGTSESATPESGPGSEPATSGS | 50 |

TABLE 4-continued

XTEN Polypeptides

| XTEN Name | Amino Acid Sequence | SEQ ID NO: |
|---|---|---|
| AE42_2 | PAGSPTSTEEGTSTEPSEGSAPGTSESATPESGPGSEPATSG | 51 |
| AE42_3 | SEPATSGSETPGTSESATPESGPGTSTEPSEGSAPGSPAGSP | 52 |
| AG42_1 | GAPSPSASTGTGPGTPGSGTASSSPGSSTPSGATGSPGPSGP | 53 |
| AG42_2 | GPGTPGSGTASSSPGSSTPSGATGSPGSSPSASTGTGPGASP | 54 |
| AG42_3 | SPSASTGTGPGASPGTSSTGSPGTPGSGTASSSPGSSTPSGA | 55 |
| AG42_4 | SASTGTGPGASPGTSSTGSPGTPGSGTASSSPGSSTPSGATG | 56 |
| AE48 | MAEPAGSPTSTEEGTPGSGTASSSPGSSTPSGATGSPGASPGTSSTGS | 57 |
| AM48 | MAEPAGSPTSTEEGASPGTSSTGSPGSSTPSGATGSPGSSTPSGATGS | 58 |
| AE144 | GSEPATSGSETPGTSESATPESGPGSEPATSGSETPGSPAGSPTSTEEGTSTEPSEGSAPGS EPATSGSETPGSEPATSGSETPGSEPATSGSETPGTSTEPSEGSAPGTSESATPESGPGSEP ATSGSETPGTSTEPSEGSAP | 59 |
| AE144_1A | SPAGSPTSTEEGTSESATPESGPGTSTEPSEGSAPGSPAGSPTSTEEGTSTEPSEGSAPGTS TEPSEGSAPGTSESATPESGPGSEPATSGSETPGSEPATSGSETPGSPAGSPTSTEEGTSES ATPESGPGTSTEPSEGSAPG | 60 |
| AE144_2A | TSTEPSEGSAPGSPAGSPTSTEEGTSTEPSEGSAPGTSTEPSEGSAPGTSESATPESGPGTS TEPSEGSAPGTSESATPESGPGSEPATSGSETPGTSTEPSEGSAPGTSTEPSEGSAPGTSES ATPESGPGTSESATPESGPG | 61 |
| AE144_2B | TSTEPSEGSAPGSPAGSPTSTEEGTSTEPSEGSAPGTSTEPSEGSAPGTSESATPESGPGTS TEPSEGSAPGTSESATPESGPGSEPATSGSETPGTSTEPSEGSAPGTSTEPSEGSAPGTSES ATPESGPGTSESATPESGPG | 62 |
| AE144_3A | SPAGSPTSTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGSPAG SPTSTEEGTSTEPSEGSAPG | 63 |
| AE144_3B | SPAGSPTSTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGSPAG SPTSTEEGTSTEPSEGSAPG | 64 |
| AE144_4A | TSESATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEGTSES ATPESGPGTSTEPSEGSAPG | 65 |
| AE144_4B | TSESATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEGTSES ATPESGPGTSTEPSEGSAPG | 66 |
| AE144_5A | TSESATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGSPAG SPTSTEEGSPAGSPTSTEEG | 67 |
| AE144_6B | TSTEPSEGSAPGTSESATPESGPGTSESATPESGPGTSESATPESGPGSEPATSGSETPGSE PATSGSETPGSPAGSPTSTEEGTSTEPSEGSAPGTSTEPSEGSAPGSEPATSGSETPGTSES ATPESGPGTSTEPSEGSAPG | 68 |
| AF144 | GTSTPESGSASPGTSPSGESSTAPGTSPSGESSTAPGSTSSTAESPGPGSTSESPSGTAPGS TSSTAESPGPGTSPSGESSTAPGTSTPESGSASPGSTSSTAESPGPGTSPSGESSTAPGTSPS GESSTAPGTSPSGESSTAP | 69 |
| AG144_1 | SGTASSSPGSSTPSGATGSPGPTGSGTASSSPGSSTPSGATGSPGSSPSA STGTGPGSSPSASTGTGPGASPGTSSTGSPGTPGSGTASSSPGSSTPSGATGSPGSSPSAST GTGPGSSPSASTGTGPGASP | 70 |
| AG144_2 | PGSSPSASTGTGPGSSPSASTGTGPGTPGSGTASSSPGSSTPSGATGSPGSSPSASTGTGP GASPGTSSTGSPGTPGSGTASSSPGSSTPSGATGSPGTPGSGTASSSPGASPGTSSTGSPG ASPGTSSTGSPGTPGSGTASSS | 71 |
| AG144_A | GASPGTSSTGSPGSSPSASTGTGPGSSPSASTGTGPGTPGSGTASSSPGSSTPSGATGSPG SSPSASTGTGPGASPGTSSTGSPGTPGSGTASSSPGSSTPSGATGSPGTPGSGTASSSPGA SPGTSSTGSPGASPGTSSTGSP | 72 |

TABLE 4-continued

XTEN Polypeptides

| XTEN Name | Amino Acid Sequence | SEQ ID NO: |
|---|---|---|
| AG144_B | GTPGSGTASSSPGSSTPSGATGSPGASPGTSSTGSPGTPGSGTASSSPGSSTPSGATGSPG SSPSASTGTGPGSSPSASTGTGPGSSTPSGATGSPGSSTPSGATGSPGASPGTSSTGSPGA SPGTSSTGSPGASPGTSSTGSP | 73 |
| AG144_C | GTPGSGTASSSPGASPGTSSTGSPGASPGTSSTGSPGASPGTSSTGSPGSSPSASTGTGPG TPGSGTASSSPGASPGTSSTGSPGASPGTSSTGSPGASPGTSSTGSPGSSTPSGATGSPGSS TPSGATGSPGASPGTSSTGSP | 74 |
| AG144_F | GSSPSASTGTGPGSSPSASTGTGPGASPGTSSTGSPGASPGTSSTGSPGSSTPSGATGSPG SSPSASTGTGPGASPGTSSTGSPGSSPSASTGTGPGTPGSGTASSSPGSSTPSGATGSPGSS TPSGATGSPGASPGTSSTGSP | 75 |
| AG144_3 | GTPGSGTASSSPGSSTPSGATGSPGSSTPSGATGSPGSSPSASTGTGPGSSPSASTGTGPG ASPGTSSTGSPGTPGSGTASSSPGSSTPSGATGSPGSSPSASTGTGPGSSPSASTGTGPGA SPGTSSTGSPGASPGTSSTGSP | 76 |
| AG144_4 | GTPGSGTASSSPGSSTPSGATGSPGSSPSASTGTGPGSSPSASTGTGPGASPGTSSTGSPG ASPGTSSTGSPGSSTPSGATGSPGSSPSASTGTGPGASPGTSSTGSPGSSPSASTGTGPGTP GSGTASSSPGSSTPSGATGSP | 77 |
| AE288_1 | GTSESATPESGPGSEPATSGSETPGTSESATPESGPGSEPATSGSETPGTSESATPESGPGT STEPSEGSAPGSPAGSPTSTEEGTSESATPESGPGSEPATSGSETPGTSESATPESGPGSPA GSPTSTEEGSPAGSPTSTEEGTSTEPSEGSAPGTSESATPESGPGSEPATSGSETPESGPGTSESA TPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAP | 78 |
| AE288_2 | GSPAGSPTSTEEGTSESATPESGPGSEPATSGSETPGTSESATPESGPGTSTEPSEGSAPGT STEPSEGSAPGTSTEPSEGSAPGTSTEPSEGSAPGTSTEPSEGSAPGTSTEPSEGSAPGSPA GSPTSTEEGTSTEPSEGSAPGTSESATPESGPGSEPATSGSETPGTSESATPESGPGSEPAT SGSETPGTSESATPESGPGTSTEPSEGSAPGTSESATPESGPGSPAGSPTSTEEGSPAGSPT STEEGSPAGSPTSTEEGTSESATPESGPGTSTEPSEGSAP | 79 |
| AG288_1 | PGASPGTSSTGSPGASPGTSSTGSPGTPGSGTASSSPGSSTPSGATGSPGTPGSGTASSSP GSSTPSGATGSPGTPGSGTASSSPGSSTPSGATGSPGSSTPSGATGSPGSSPSASTGTGPG SSPSASTGTGPGASPGTSSTGSPGTPGSGTASSSPGSSTPSGATGSPGSSPSASTGTGPGSS PSASTGTGPGASPGTSSTGSPGASPGTSSTGSPGSSTPSGATGSPGSSPSASTGTGPGASP GTSSTGSPGSSPSASTGTGPGTPGSGTASSSPGSSTPSGATGS | 80 |
| AG288_2 | GSSPSASTGTGPGSSPSASTGTGPGTPGSGTASSSPGSSTPSGATGSPGSSPSASTGTGPG ASPGTSSTGSPGTPGSGTASSSPGSSTPSGATGSPGTPGSGTASSSPGSSTPSGATGSPGA SPGTSSTGSPGTPGSGTASSSPGSSTPSGATGSPGASPGTSSTGSPGTPGSGTASSSPGSST PSGATGSPGSSPSASTGTGPGSSPSASTGTGPGSSTPSGATGSPGSSTPSGATGSPGASPG TSSTGSPGASPGTSSTGSPGASPGTSSTGSPGTPGSGTASSSP | 81 |
| AF504 | GASPGTSSTGSPGSSPSASTGTGPGSSPSASTGTGPGTPGSGTASSSPGSSTPSGATGSPG SXPSASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPGTPG SGTASSSPGSSTPSGATGSPGASPGSXPSASTGTGPGSSPSASTGTGPGSSTPSGATGSPGSS GATGSPGASPGTSSTGSPGASPGTSSTGSPGASPGTSSTGSPGTPGSGTASSSPGASPGTS STGSPGASPGTSSTGSPGASPGTSSTGSPGSSPSASTGTGPGTPGSGTASSSPGASPGTSST GSPGASPGTSSTGSPGASPGTSSTGSPGSSTPSGATGSPGSSTPSGATGSPGASPGTSSTG SPGTPGSGTASSSPGSSTPSGATGSPGSSTPSGATGSPGSSTPSGATGSPGSSPSASTGTGP GASPGTSSTGSP | 82 |
| AF540 | GSTSSTAESPGPGSTSSTAESPGPGSTSESPSGTAPGSTSSTAESPGPGSTSSTAESPGPGT STPESGSASPGSTSESPSGTAPGTSPSGESSTAPGSTSESPSGTAPGSTSESPSGTAPGSTSESPS GESSTAPGSTSESPSGTAPGSTSESPSGTAPGSTSESPSGTAPGSTSESPS GTAPGSTSESPSGTAPGTSTPESGSASPGSTSESPSGTAPGTSTPESGSASPGSTSSTAESP GPGSTSSTAESPGPGTSTPESGSASPGTSTPESGSASPGSTSESPSGTAPGSTSTPESGSASP GTSTPESGSASPGSTSESPSGTAPGSTSESPSGTAPGSTSESPSGTAPGSTSSTAESPGPGT STPESGSASPGTSTPESGSASPGSTSESPSGTAPGSTSTPESGSASPGSTSE SPSGTAPGSTSESPSGTAPGTSTPESGSASPGTSSTAESPGPGTSPSGE SSTAPGSTSSTAESPGPGTSTPESGSASPGSTSESPSGTAP | 83 |
| AD576 | GSSESGSSEGGPGSGGEPSESGSGSSESGSSEGGPGSSESGSSEGGPGSSESGSSEGGPG SSESGSSEGGPGSSESGSSEGGPGESPGGSSGSESGSSEGGPGESSGSSESGSSEGGPGSS ESGSSEGGPGSSESGSSEGGPGSGGEPSESGSSGESPGGSSGSESGESPGGSSGSESGSGG EPSESGSSGSSESGSSEGGPGSGGEPSESGSSGSGGGEPSESGSSGSEGSSGPGESSGESPGG SSGESGSSGGGEPSESGSSGGGGEPSESGSSGSEGSSGPGESSGESPGG GSESGESPGGSSGSESGESPGGSSGSESGESPGGSSGSESGESGSSEG GPGSGGEPSESGSSGSEGSSGPGESSSESGSSEGGPGSSESGSSEGGPGSSESGSSEGG PGSGGEPSESGSSGESPGGSSGSESGESPGGSSGSESGSSEGGPGSGGEPSESGSS GSSESGSSEGGPGSGGEPSESGSSGSGGEPSESGSSGESPGGSSGSESGSEGSSGPGESSG SSESGSSEGGPGSEGSSGPGESS | 84 |

TABLE 4-continued

XTEN Polypeptides

| XTEN Name | Amino Acid Sequence | SEQ ID NO: |
|---|---|---|
| AE576 | GSPAGSPTSTEEGTSESATPESGPGTSTEPSEGSAPGSPAGSPTSTEEGTSTEPSEGSAPGT STEPSEGSAPGTSESATPESGPGSEPATSGSETPGSEPATSGSETPGSPAGSPTSTEEGTSE SATPESGPGTSTEPSEGSAPGTSTEPSEGSAPGSPAGSPTSTEEGTSTEPSEGSAPGTSTEP SEGSAPGTSESATPESGPGTSTEPSEGSAPGTSESATPESGPGSEPATSGSETPGTSTEPSE GSAPGTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSEGSAP GTSTEPSEGSAPGTSTEPSEGSAPGTSTEPSEGSAPGSPAGSPTSTEEGTSTEPSEGSAPGT SESATPESGPGSEPATSGSETPGTSESATPESGPGSEPATSGSETPGTSESATPESGPGTST EPSEGSAPGTSESATPESGPGSPAGSPTSTEEGSPAGSPTSTEEGSPAGSPTSTEEGTSESA TPESGPGTSTEPSEGSAP | 85 |
| AF576 | GSTSSTAESPGPGSTSSTAESPGPGSTSESPSGTAPGSTSSTAESPGPGSTSSTAESPGPGT STPESGSASPGSTSESPSGTAPGTSPSGESSTAPGSTSESPSGTAPGSTSESPSGTAPGTSPS GESSTAPGSTSESPSGTAPGSTSESPSGTAPGTSPSGESSTAPGSTSESPSGTAPGSTSESPS GTAPGSTSESPSGTAPGTSTPESGSASPGSTSESPSGTAPGSTSTPESGSASPGSTSSTAESP GPGSTSSTAESPGPGTSTPESGSASPGTSTPESGSASPGSTSESPSGTAPGSTSTPESGSASP GTSTPESGSASPGSTSESPSGTAPGSTSESPSGTAPGSTSSTAESPGPGT STPESGSASPGTSTPESGSASPGSTSESPSGTAPGSTSESPSGTAPGTSTPESGSASPGSTSE SPSGTAPGSTSESPSGTAPGTSTPESGSASPGTSPSGESSTAPGSTSSTAESPGPGTSPSGE SSTAPGSTSSTAESPGPGTSTPESGSASPGSTSESPSGTAPGSTSSTAESPGPGTSTPESGS ASPGTSTPESGSASP | 86 |
| AG576 | PGTPGSGTASSSPGSSTPSGATGSPGSSPSASTGTGPGSSPSASTGTGPGSSTPSGATGSP GSSTPSGATGSPGASPGTSSTGSPGASPGTSSTGSPGASPGTSSTGSPGTPGSGTASSSPG ASPGTSSTGSPGASPGTSSTGSPGASPGTSSTGSPGSSPSASTGTGPGTPGSGTASSSPGA SPGTSSTGSPGASPGTSSTGSPGASPGTSSTGSPGSSTPSGATGSPGSSTPSGATGSPGASP GTSSTGSPGTPGSGTASSSPGSSTPSGATGSPGSSTPSGATGSPGSSTPSGATGSPGSSPSA STGTGPGASPGTSSTGSPGASPGTSSTGSPGTPGSGTASSSPGASPGTSSTGSPGASPGTS STGSPGASPGTSSTGSPGASPGTSSTGSPGTPGSGTASSSPGSSTPSGATGSPGTPGSGTA SSSPGSSTPSGATGSPGTPGSGTASSSPGSSTPSGATGSPGSSTPSGATGSPGSSPSASTGT GPGSSPSASTGTGPGASPGTSSTGSPGTPGSGTASSSPGSSTPSGATGSPGSSPSASTGTG PGSSPSASTGTGPGASPGTSSTGS | 87 |
| AE624 | MAEPAGSPTSTEEGTPGSGTASSSPGSSTPSGATGSPGASPGTSSTGSPGSPAGSPTSTEE GTSESATPESGPGTSTEPSEGSAPGSPAGSPTSTEEGTSTEPSEGSAPGTSTEPSEGSAPGT SESATPESGPGSEPATSGSETPGSEPATSGSETPGSPAGSPTSTEEGTSESATPESGPGTST EPSEGSAPGTSTEPSEGSAPGSPAGSPTSTEEGTSTEPSEGSAPGTSTEPSEGSAPGTSESA TPESGPGTSTEPSEGSAPGTSESATPESGPGSEPATSGSETPGTSTEPSEGSAPGTSTEPSE GSAPGTSESATPESGPGTSESATPESGPGSPAGSPTSTEEGTSESATPESGPGSEPATSGSE TPGTSESATPESGPGTSTEPSEGSAPGTSTEPSEGSAPGTSTEPSEGSAPGTSTEPSEGSAP GTSTEPSEGSAPGSPAGSPTSTEEGTSTEPSEGSAPGTSESATPESGPGS EPATSGSETPGTSESATPESGPGSEPATSGSETPGTSESATPESGPGTSTEPSEGSAPGTSE SATPESGPGSPAGSPTSTEEGSPAGSPTSTEEGSPAGSPTSTEEGTSESATPESGPGTSTEP SEGSAP | 88 |
| AD836 | GSSESGSSEGGPGSSESGSSEGGPGESPGGSSGSESGSGGGEPSESGSSGESPGGSSGSESG ESPGGSSGSESGSSESGSSEGGPGSSESGSSEGGPGSSESGSSEGGPGESPGGSSGSESGES PGGSSGSESGESPGGSSGSESGSSESGSSEGGPGSSESGSSEGGPGSSESGSSEGGPGSSES GSSEGGPGSSESGSSEGGPGSSESGSSEGGPGSGGEPSESGSSGESPGGSGSESGESPGG SSGSESGSGGEPSESGSSGSEGSSGPGESSGSSESGSSEGGPGSGGEPSESGSSGSEGSSGP GESSGSSESGSSEGGPGSGGEPSESGSSGESPGGSSGSESGSGGEPSESGSSGSGGEPSES GSSGSSESGSSEGGPGSGGEPSESGSSGGESPGGSGSESGSSGGEPSESGSSGSSGGEPSGGSGS ESGSSGSSGPGESSGSEGSSGPGESSGGEPSESGSSGSSESGSSEGGPGSSESGSSEGGP GESPGGSSGSESGSGGEPSESGSSGSEGSSGPGESSGESPGGSSGSESGSEGSSGPGSSES GSSEGGPGSGGEPSESGSSGSEGSSGPGESSGSEGSSGPGESSGSEGSSGPGESSGSGGEP SESGSSGSGGEPSESGSSGESPGGSSGSESGSPGGSSGSESGSGGEPSESGSSGSEGSSGP GESSGESPGGSSGSESGSSESGGPGSSESGSSEGGPGSSESGSSEGGPGSSGGEPSES GSSGSSESGSSEGGPGESPGGSSGSESGSGGGEPSESGSSGSSESGSSEGGPGSSGGSSGS ESGSGGEPSESGSSGESPGGSSGSESGSGGEPSESGSS | 89 |
| AE864 | GSPAGSPTSTEEGTSESATPESGPGTSTEPSEGSAPGSPAGSPTSTEEGTSTEPSEGSAPGT STEPSEGSAPGTSESATPESGPGSEPATSGSETPGSEPATSGSETPGSPAGSPTSTEEGTSE SATPESGPGTSTEPSEGSAPGTSTEPSEGSAPGSPAGSPTSTEEGTSTEPSEGSAPGTSTEP SEGSAPGTSESATPESGPGTSTEPSEGSAPGTSESATPESGPGSEPATSGSETPGTSTEPSE GSAPGTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSEGSAP GTSTEPSEGSAPGTSTEPSEGSAPGSPAGSPTSTEEGTSTEPSEGSAPGT STEPSEGSAPGTSTEPSEGSAPGTSTEPSEGSAPGSPAGSPTSTEEGTSTEPSEGSAPGT SESATPESGPGSEPATSGSETPGTSESATPESGPGSEPATSGSETPGTSESATPESGPGTST EPSEGSAPGTSESATPESGPGSPAGSPTSTEEGSPAGSPTSTEEGTSESA TPESGPGTSTEPSEGSAPGTSESATPESGPGSEPATSGSETPGTSESATPESGPGSEPATSG SETPGTSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESATPESGP GTSESATPESGPGTSESATPESGPGSEPATSGSETPGSEPATSGSETPGSPAGSPTSTEEGT STEPSEGSAPGTSTEPSEGSAPGSEPATSGSETPGTSESATPESGPGTSTEPSEGSAP | 90 |

TABLE 4-continued

XTEN Polypeptides

| XTEN Name | Amino Acid Sequence | SEQ ID NO: |
|---|---|---|
| AF864 | GSTSESPSGTAPGTSPSGESSTAPGSTSESPSGTAPGSTSESPSGTAPGTSTPESGSASPGT STPESGSASPGSTSESPSGTAPGSTSESPSGTAPGTSPSGESSTAPGSTSESPSGTAPGTSPS GESSTAPGTSPSGESSTAPGSTSSTAESPGPGTSPSGESSTAPGTSPSGESSTAPGSTSSTA ESPGPGTSTPESGSASPGTSTPESGSASPGSTSESPSGTAPGSTSESPSGTAPGTSTPESGS ASPGSTSSTAESPGPGTSTPESGSASPGSTSESPSGTAPGTSPSGESSTAPGSTSSTAESPG PGTSPSGESSTAPGTSTPESGSASPGSTSSTAESPGPGSTSSTAESPGPGSTSSTAESPGPG STSSTAESPGPGTSPSGESSTAPGSTSESPSGTAPGSTSESPSGTAPGTSTPESGPXXXGAS ASGAPSTXXXXSESPSGTAPGSTSESPSGTAPGSTSESPSGTAPGSTSESPSGTAPGSTSES PSGTAPGSTSESPSGTAPGTSTPESGSASPGTSPSGESSTAPGTSPSGESSTAPGSTSSTAE SPGPGTSPSGESSTAPGTSTPESGSASPGSTSESPSGTAPGSTSESPSGTAPGTSPSGESST APGSTSESPSGTAPGTSTPESGSASPGTSTPESGSASPGSTSESPSGTAPGTSTPESGSASP GSTSSTAESPGPGSTSESPSGTAPGSTSESPSGTAPGTSPSGESSTAPGSTSSTAESPGPGT SPSGESSTAPGTSTPESGSASPGTSPSGESSTAPGTSPSGESSTAPGTSPSGESSTAPGSTSS TAESPGPGSTSSTAESPGPGTSPSGESSTAPGSSPSASTGTGPGSSTPSGATGSPGSSTPSG ATGSP | 91 |
| AG864_ 2 | GASPGTSSTGSPGSSPSASTGTGPGSSPSASTGTGPGTPGSGTASSSPGSSTPSGATGSPG SSPSASTGTGPGASPGTSSTGSPGTPGSGTASSSPGSSTPSGATGSPGTPGSGTASSSPGA SPGTSSTGSPGASPGTSSTGSPGTPGSGTASSSPGSSTPSGATGSPGASPGTSSTGSPGTPG SGTASSSPGSSTPSGATGSPGSSPSASTGTGPGSSPSASTGTGPGSSTPSGATGSPGSSTPS GATGSPGASPGTSSTGSPGASPGTSSTGSPGASPGTSSTGSPGTPGSGTASSSPGASPGTS STGSPGASPGTSSTGSPGASPGTSSTGSPGSSPSASTGTGPGTPGSGTASSSPGASPGTSST GSPGASPGTSSTGSPGASPGTSSTGSPGSSTPSGATGSPGSSTPSGATGSPGASPGTSSTG SPGTPGSGTASSSPGSSTPSGATGSPGSSTPSGATGSPGSSTPSGATGSPGSSPSASTGTGP GASPGTSSTGSPGASPGTSSTGSPGTPGSGTASSSPGASPGTSSTGSPGASPGTSSTGSPG ASPGTSSTGSPGASPGTSSTGSPGTPGSGTASSSPGSSTPSGATGSPGTPGSGTASSSPGSS TPSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPGSSPSA STGTGPGASPGTSSTGSPGASPGTSSTGSPGSSTPSGATGSPGSSPSASTGTGPGASPGTS STGSPGSSPSASTGTGPGTPGSGTASSSPGSSTPSGATGSPGSSTPSGATGSPGASPGTSST GSP | 92 |
| AM875 | GTSTEPSEGSAPGSEPATSGSETPGSPAGSPTSTEEGSTSSTAESPGPGTSTPESGSASPGS TSESPSGTAPGSTSESPSGTAPGTSTPESGSASPGTSTPESGSASPGSEPATSGSETPGTSE SATPESGPGSPAGSPTSTEEGTSTEPSEGSAPGTSESATPESGPGTSTEPSEGSAPGTSTEP SEGSAPGSPAGSPTSTEEGTSTEPSEGSAPGTSTEPSEGSAPGTSESATPESGPGTSESATP ESGPGTSTEPSEGSAPGTSTEPSEGSAPGTSESATPESGPGTSTEPSEGSAPGSEPATSGSE TPGSPAGSPTSTEEGSSTPSGATGSPGTPGSGTASSSPGSSTPSGATGSPGTSTEPSEGSAP GTSTEPSEGSAPGSEPATSGSETPGSPAGSPTSTEEGSPAGSPTSTEEGTSTEPSEGSAPGA SASGAPSTGGTSESATPESGPGSPAGSPTSTEEGSPAGSPTSTEEGSTSSTAESPGPGSTSE SPSGTAPGTSPSGESSTAPGTPGSGTASSSPGSSTPSGATGSPGSSPSASTGTGPGSEPATS GSETPGTSESATPESGPGSEPATSGSETPGSTSSTAESPGPGSTSSTAESPGPGTSPSGESS TAPGSEPATSGSETPGSEPATSGSETPGTSTEPSEGSAPGSTSSTAESPGPGTSTPESGSAPG STSESPSGTAPGTSTEPSEGSAPGTSTEPSEGSAPGTSTEPSEGSAPGSSTPSGATGSPG SSPSASTGTGPGASPGTSSTGSPGSEPATSGSETPGTSESATPESGPGSPAGSPTSTEEGSS TPSGATGSPGSSPSASTGTGPGASPGTSSTGSPGTSESATPESGPGTSTEPSEGSAPGTSTE PSEGSAP | 93 |
| AE912 | MAEPAGSPTSTEEGTPGSGTASSSPGSSTPSGATGSPGASPGTSSTGSPGSPAGSPTSTEE GTSESATPESGPGTSTEPSEGSAPGSPAGSPTSTEEGTSTEPSEGSAPGTSTEPSEGSAPGT SESATPESGPGSEPATSGSETPGSEPATSGSETPGSPAGSPTSTEEGTSESATPESGPGTST EPSEGSAPGTSTEPSEGSAPGSPAGSPTSTEEGTSTEPSEGSAPGTSTEPSEGSAPGTSESA TPESGPGTSTEPSEGSAPGTSESATPESGPGSEPATSGSETPGTSTEPSEGSAPGTSTEPSE GSAPGTSESATPESGPGTSESATPESGPGSPAGSPTSTEEGTSESATPESGPGSEPATSGSE TPGTSESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESATPESGPGS EPATSGSETPGTSESATPESGPGSEPATSGSETPGTSESATPESGPGTSTEPSEGSAPGTSE SATPESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTSESATP ESGPGTSTEPSEGSAPGSPAGSPTSTEEGSAPGSETPGTSESATPESGPGTSESATPESGP GPGSPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGSAPGT STEPSEGSAPGSEPATSGSETPGTSESATPESGPGTSTEPSEGSAP | 94 |
| AM923 | MAEPAGSPTSTEEGASPGTSSTGSPGSSTPSGATGSPGASSTPSGATGSPGTSTEPSEGSAP GSEPATSGSETPGSPAGSPTSTEEGSTSSTAESPGPGTSTPESGSASPGSTSESPSGTAPGS TSESPSGTAPGTSTPESGSASPGTSTPESGSASPGSEPATSGSETPGTSESATPESGPGSPA GSPTSTEEGTSTEPSEGSAPGTSESATPESGPGTSTEPSEGSAPGTSESATPESGPGTSTEPSE GSAPGTSTEPSEGSAPGTSESATPESGPGTSTEPSEGSAPGSEPATSGSETPGSPAGSPTST EEGSSTPSGATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGASASGAPSTGGT SESATPESGPGSPAGSPTSTEEGSPAGSPTSTEEGSTSSTAESPGPGSTSESPSGTAPGTSP | 95 |

TABLE 4-continued

XTEN Polypeptides

| XTEN Name | Amino Acid Sequence | SEQ ID NO: |
|---|---|---|
| | SGESSTAPGTPGSGTASSSPGSSTPSGATGSPGSSPSASTGTGPGSEPATSGSETPGTSESA<br>TPESGPGSEPATSGSETPGTSTSTAESPGPGSTSSTAESPGPGTSPSGESSTAPGSEPATSG<br>SETPGSEPATSGSETPGTSTEPSEGSAPGSTSSTAESPGPGSTSTPESGSASPGSTSESPSGT<br>APGTSTEPSEGSAPGTSTEPSEGSAPGTSTEPSEGSAPGSSTPSGATGSPGSSPSASTGTGP<br>GASPGTSSTGSPGSEPATSGSETPGTSESATPESGPGSPAGSPTSTEEGSSTPSGATGSPGS<br>SPSASTGTGPGASPGTSSTGSPGTSESATPESGPGTSTEPSEGSAPGTSTEPSEGSAP | |
| AM1318 | GTSTEPSEGSAPGSEPATSGSETPGSPAGSPTSTEEGSTSSTAESPGPGTSTPESGSASPGS<br>TSESPSGTAPGSTSESPSGTAPGTSTPESGSASPGTSTPESGSASPGSEPATSGSETPGTSE<br>SATPESGPGSPAGSPTSTEEGTSTEPSEGSAPGTSESATPESGPGTSTEPSEGSAPGTSTEP<br>SEGSAPGSPAGSPTSTEEGTSTEPSEGSAPGTSTEPSEGSAPGTSESATPESGPGTSESATP<br>ESGPGTSTEPSEGSAPGTSTEPSEGSAPGTSESATPESGPGTSTEPSEGSAPGSEPATSGSE<br>TPGSPAGSPTSTEEGSSTPSGATGSPGTPGSGTASSSPGSSTPSGATGSPGTSTEPSEGSAP<br>GTSTEPSEGSAPGSEPATSGSETPGSPAGSPTSTEEGSPAGSPTSTEEGTSTEPSEGSAPGP<br>EPTGPAPSGGSEPATSGSETPGTSESATPESGPGSPAGSPTSTEEGTSESATPESGPGSPA<br>GSPTSTEEGSPAGSPTSTEEGTSESATPESGPGSPAGSPTSTEEGSPAGSPTSTEEGSTSST<br>AESPGPGSTSESPSGTAPGTSPSGESSTAPGSTSESPSGTAPGSTSESPSGTAPGTSPSGES<br>STAPGTSTEPSEGSAPGTSESATPESGPGTSESATPESGPGSEPATSGSETPGTSESATPES<br>GPGTSESATPESGPGTSTEPSEGSAPGTSESATPESGPGTSPSGESSTAP<br>GTSPSGESSTAPGTSPSGESSTAPGTSTEPSEGSAPGSPAGSPTSTEEGTSTEPSEGSAPGS<br>SPSASTGTGPGSSTPSGATGSPGSSTPSGATGSPGSSTPSGATGSPGSSTPSGATGSPGAS<br>PGTSSTGSPGASASGAPSTGGTSPSGESSTAPGSTSSTAESPGPGTSPSGESSTAPGTSESA<br>TPESGPGTSTEPSEGSAPGTSTEPSEGSAPGSSPSASTGTGPGSSTPSGATGSPGASPGTSS<br>TGSPGTSTPESGSASPGTSPSGESSTAPGTSPSGESSTAPGTSESATPESGPGSEPATSGSE<br>TPGTSTEPSEGSAPGSTSESPSGTAPGSTSESPSGTAPGTSTPESGSASPGSPAGSPTSTEE<br>GTSESATPESGPGTSTEPSEGSAPGSPAGSPTSTEEGTSESATPESGPGSEPATSGSETPGS<br>STPSGATGSPGSASPGTSSTGSPGSSTPSGATGSPGSTSESPSGTAPGTSPSGESSTAPGSTS<br>STAESPGPGSSTPSGATGSPGASPGTSSTGSPGTPGSGTASSSPGSPAGSPTSTEEGSPAG<br>SPTSTEEGTSTEPSEGSAP | 96 |
| BC 864 | GTSTEPSEPGSAGTSTEPSEPGSAGSEPATSGTEPSGSGASEPTSTEPGSEPATSGTEPSGS<br>EPATSGTEPSGSEPATSGTEPSGSGASEPTSTEPSEPGSAGSEPATSGTEPSGTSTST<br>EPSEPGSAGSEPATSGTEPSGSEPATSGTEPSGTSTEPSEPGSAGTSTEPSEPGSAGSEPAT<br>SGTEPSGSEPATSGTEPSGTSTEPSEPGAGSGASEPTSTEPGTSEPSTSEPGAGSEPATSG<br>TEPSGSEPATSGTEPSGTSTEPSEPGSAGTSTEPSEPGSAGSGASEPTSTEPGSEPATSGTE<br>PSGSEPATSGTEPSGSEPATSGTEPSGTSTEPSEPGSAGSEPATSGTEPS<br>GSGASEPTSTEPGTSTEPSEPGSAGSEPATSGTEPSGSGASEPTSTEPGTSTEPSEPGSAGS<br>GASEPTSTEPGSEPATSGTEPSGSGASEPTSTEPGSEPATSGTEPSGSGASEPTSTEPGTST<br>EPSEPGSAGSEPATSGTEPSGSGASEPTSTEPGTSTEPSEPGSAGSEPATSGTEPSGTSTEP<br>SEPGSAGSEPATSGTEPSGTSTEPSEPGSAGTSTEPSEPGSAGTSTEPSE<br>PGSAGTSTEPSEPGSAGTSTEPSEPGSAGTSEPSTSEPGAGSGASEPTSTEPGTSTEPSEPG<br>SAGTSTEPSEPGSAGTSTEPSEPGSAGSEPATSGTEPSGSGASEPTSTEPGSEPATSGTEPS<br>GSEPATSGTEPSGSEPATSGTEPSGSEPATSGTEPSGTSTEPSTSEPGAGSEPATSGTEPSGS<br>GASEPTSTEPGTSTEPSEPGSAGSEPATSGTEPSGSGASEPTSTEPGTSTEPSEPGSA | 97 |
| BD864 | GSETATSGSETAGTSESATSESGAGSTAGSETSTEAGTSESATSESGAGSETATSGSETA<br>GSETATSGSETAGTSTEASEGSASGTSTEASEGSASGTSESATSESGAGSETATSGSETA<br>GTSTEASEGSASGTSTAGSETSTEAGTSESATSESGAGSTAGSETSTEAGSETATSGSETA<br>GTSESATSESGAGTSTEASEGSASGSETATSGSETAGSETATSGSETAGTSTEASEGSAS<br>GSTAGSETSTEAGTSESATSESGAGTSTEASEGSASGSETATSGSETAGSTAGSETSTEA<br>GSTAGSETSTEAGSETATSGSETAGTSESATSESGAGTSESATSESGAGSETATSGSETA<br>GTSESATSESGAGTSESATSESGAGSETATSGSETAGTSESATSESGAGSETATSGSETA<br>GTSTEASEGSASGTSTEASEGSASGSETATSGSETAGSTAGSETSTEAGSTAGSETSTEA<br>GSTAGSETSTEAGSETATSGSETAGTSTEASEGSASGSTAGSETSTEAGSETATSGSETA<br>GTSESATSESGAGTSESATSESGAGSETATSGSETAGTSESATSESGAGSETATSGSETA<br>GTSTEASEGSASGTSEASEGSASGSTAGSETSTEAGSTAGSETSTEAGSETATSGSETA<br>GTSESATSESGAGTSESATSESGAGSETATSGSETAGSETATSGSETAGSETATSGSETA<br>GTSTEASEGSASGTSESATSESGAGSETATSGSETAGSETATSGSETAGTSESATSESGA<br>GTSESATSESGAGSETATSGSETA | 98 |
| AE948 | GTSTEPSEGSAPGTSESATPESGPGSEPATSGSETPGTSESATPESGPGTSTEPSEGSAPGS<br>PAGSPTSTEEGTSTEPSEGSAPGSEPATSGSETPGTSESATPESGPGTSESATPESGPGSEP<br>ATSGSETPGTSTEPSEGSAPGTSESATPESGPGTSTEPSEGSAPGTSTEPSEGSAPGSEPAT<br>SGSETPGTSTEPSEGSAPGSEPATSGSETPGSEPATSGSETPGTSTEPSEGSAPGSEPATSG<br>SETPGSEPATSGSETPGTSTEPSEGSAPGSEPATSGSETPGSPAGSPTSTEEGTSESATPES<br>GPGTSTEPSEGSAPGSEPATSGSETPGTSESATPESGPGSEPATSGSETPGSEPATSGSETP<br>GTSESATPESGPGSPAGSPTSTEEGTSESATPESGPGSPAGSPTSTEEGTSTEPSEGSAPGT<br>SESATPESGPGTSTEPSEGSAPGTSTEPSEGSAPGSPAGSPTSTEEGTSTEPSEGSAPGTSE<br>SATPESGPGSPAGSPTSTEEGSPAGSPTSTEEGTSESATPESGPGTSESATPESGPGTSTEP<br>SEGSAPGSPAGSPTSTEEGTSESATPESGPGTSTEPSEGSAPGSEPATSGSETPGSPAGSPT<br>STEEGTSESATPESGPGTSTEPSEGSAPGSEPATSGSETPGSEPATSGSETPGSEPATSGSE<br>TPGSPAGSPTSTEEGTSESATPESGPGSEPATSGSETPGSEPATSGSETPGSPAGSPTSTEE<br>GSPAGSPTSTEEGSPAGSPTSTEEGTSESATPESGPGSEPATSGSETPGTSTEPSEGSAPGT | 99 |

TABLE 4-continued

XTEN Polypeptides

| XTEN Name | Amino Acid Sequence | SEQ ID NO: |
|---|---|---|
| | STEPSEGSAPGSPAGSPTSTEEGSPAGSPTSTEEGSPAGSPTSTEEGTSTEPSEGSAPGTSE SATPESGPGTSESATPESGPGTSTEPSEGSAPGTSTEPSEGSAPGTSTEPSEGSAPGTSESA TPESGPGTSESATPESGP | |
| AE1044 | GSEPATSGSETPGSEPATSGSETPGTSTEPSEGSAPGTSESATPESGPGSPAGSPTSTEEGT STEPSEGSAPGTSESATPESGPGTSESATPESGPGSEPATSGSETPGSEPATSGSETPGTSE SATPESGPGTSESATPESGPGSPAGSPTSTEEGTSTEPSEGSAPGSEPATSGSETPGTSTEP SEGSAPGSPAGSPTSTEEGSPAGSPTSTEEGSPAGSPTSTEEGTSTEPSEGSAPGTSESATP ESGPGSEPATSGSETPGTSESATPESGPGTSESATPESGPGSPAGSPTSTEEGTSTEPSEGS APGSEPATSGSETPGTSTEPSEGSAPGTSESATPESGPGSPAGSPTSTEEGTSTEPSEGSAP GTSTEPSEGSAPGSPAGSPTSTEEGTSTEPSEGSAPGSPAGSPAGSPTSTEEGT SESATPESGPGSEPATSGSETPGTSTEPSEGSAPGSEPATSGSETPGTSESATPESGPGTST EPSEGSAPGTSESATPESGPGTSTEPSEGSAPGTSTEPSEGSAPGSEPATSGSETPGSPAGS PTSTEEGTSESATPESGPGTSTEPSEGSAPGSPAGSPTSTEEGTSTEPSEGSAPGTSESATP ESGPGTSTEPSEGSAPGSEPATSGSETPGSEPATSGSETPGTSESATPESGPGTSESATPES GPGTSESATPESGPGTSTEPSEGSAPGTSTEPSEGSAPGSPAGSPTSTEEGSPAGSPTSTEE GTSESATPESGPGSPAGSPTSTEEGSPAGSPTSTEEGTSESATPESGPGSEPATSGSETPGT STEPSEGSAPGSEPATSGSETPGSPAGSPTSTEEGTSESATPESGPGTSESATPESGPGSEP ATSGSETPGTSTEPSEGSAPGTSTEPSEGSAPGSPAGSPTSTEEGTSTEPSEGSAPGTSTEP SEGSAPGSEPATSGSETPGSPAGSPTSTEEGTSESATPESGPGTSTEPSEGSAPGSPAGSPT STEEGTSESATPESGPGTSESATPESGPGTST | 100 |
| AE1140 | GSEPATSGSETPGSEPATSGSETPGTSTEPSEGSAPGSEPATSGSETPGTSESATPESGPGS EPATSGSETPGSPAGSPTSTEEGTSESATPESGPGSEPATSGSETPGTSTEPSEGSAPGTSE SATPESGPGTSESATPESGPGTSTEPSEGSAPGTSTEPSEGSAPGSEPATSGSETPGSPAGS PTSTEEGTSTEPSEGSAPGSEPATSGSETPGSPAGSPTSTEEGTSTEPSEGSAPGTSESATP ESGPGSPAGSPTSTEEGTSTEPSEGSAPGTSESATPESGPGSEPATSGSETPGTSESATPES GPGSEPATSGSETPGTSTEPSEGSAPGTSTEPSEGSAPGTSTEPSEGSAPGSPAGSPTSTEE GSPAGSPTSTEEGTSESATPESGPGTSTEPSEGSAPGTSTEPSEGSAPGSPAGSPTSTEEGS PAGSPTSTEEGSPAGSPTSTEEGTSESATPESGPGSEPATSGSETPGTSESATPESGPGSPA GSPTSTEEGTSTEPSEGSAPGTSESATPESGPGSEPATSGSETPGSPAGSPTSTEEGTSTEP SEGSAPGTSESATPESGPGTSESATPESGPGSPAGSPTSTEEGTSTEPSEGSAPGSPAGSPT STEEGSPAGSPTSTEEGTSESATPESGPGSEPATSGSETPGTSTEPSEGSAPGSEPATSGSE TPGTSESATPESGPGTSTEPSEGSAPGTSESATPESGPGTSESATPESGPGTSTEPSEGSAP GTSTEPSEGSAPGSEPATSGSETPGTSESATPESGPGTSTEPSEGSAPGSEPATSGSETPGS PAGSPTSTEEGTSESATPESGPGSPAGSPTSTEEGTSTEPSEGSAPGSEPATSGSETPGSEP ATSGSETPGSEPATSGSETPGTSESATPESGPGTSESATPESGPGTSTEPSEGSAPGTSTEP SEGSAPGSEPATSGSETPGTSEPSEGSAPGTSESATPESGPGSPAGSPTSTEEGSPAGSPT STEEGTSTEPSEGSAPGSPAGSPTSTEEGSPA | 101 |
| AE1236 | GSPAGSPTSTEEGTSTEPSEGSAPGSPAGSPTSTEEGTSESATPESGPGSEPATSGSETPGT STEPSEGSAPGTSTEPSEGSAPGTSESATPESGPGTSTEPSEGSAPGTSTEPSEGSAPGSEP ATSGSETPGSPAGSPTSTEEGTSESATPESGPGSPAGSPTSTEEGTSTEPSEGSAPGSPAGS PTSTEEGTSTEPSEGSAPGSPAGSPTSTEEGTSTEPSEGSAPGSPAGSPTSTEEGSPAGSPT STEEGTSTEPSEGSAPGSEPATSGSETPGSPAGSPTSTEEGTSESATPESGPGSEPATSGSE TPGSEPATSGSETPGTSESATPESGPGSPAGSPTSTEEGTSESATPESGPGSEPATSGSETP GSEPATSGSETPGTSESATPESGPGTSESATPESGPGTSTEPSEGSAPGTSTEPSEGSAPGT SESATPESGPGSPAGSPTSTEEGTSTEPSEGSAPGSEPATSGSETPGSPAGSPTSTEEGTST EPSEGSAPGTSTEPSEGSAPGSPAGSPTSTEEGSPAGSPTSTEEGSPAGSPTSTEEGTSESA TPESGPGSEPATSGSETPGTSESATPESGPGTSESATPESGPGTSTEPSEGSAPGTSESATP ESGPGSPAGSPTSTEEGTSESATPESGPGTSESATPESGPGSEPATSGSETPGSEPATSGSE TPGTSTEPSEGSAPGSPAGSPTSTEEGTSESATPESGPGTSTEPSEGSAPGTSTEPSEGSAP GSEPATSGSETPGSEPATSGSETPGTSESATPESGPGSEPATSGSETPGSPAGSPTSTEEGT SESATPESGPGSEPATSGSETPGTSTEPSEGSAPGTSESATPESGPGTSESATPESGPGTST EPSEGSAPGSEPATSGSETPGTSTEPSEGSAPGSPAGSPTSTEEGSPAGSPTSTEEGTSESA TPESGPGSEPATSGSETPGSPAGSPTSTEEGSPAGSPTSTEEGTSESATPESGPGSEPATSG SETPGTSTEPSEGSAPGTSTEPSEGSAPGSEP | 102 |
| AE1332 | GSPAGSPTSTEEGTSTEPSEGSAPGTSESATPESGPGTSESATPESGPGSEPATSGSETPGT STEPSEGSAPGTSESATPESGPGSPAGSPTSTEEGTSTEPSEGSAPGTSESATPESGPGSPA GSPTSTEEGTSTEPSEGSAPGTSESATPESGPGTSEPSEGSAPGSEPATSGSETPGSEPAT SGSETPGSEPATSGSETPGTSESATPESGPGSPAGSPTSTEEGTSESATPESGPGSEPATSG SETPGTSESATPESGPGTSESATPESGPGSPAGSPTSTEEGTSTEPSEGSAPGTSESATPES GPGTSTEPSEGSAPGTSTEPSEGSAPGTSTEPSEGSAPGSEPATSGSETPGTSTEPSEGSAP GTSESATPESGPGTSESATPESGPGTSTEPSEGSAPGTSESATPESGPGTSESATPESGPGS EPATSGSETPGTSTEPSEGSAPGTSESATPESGPGSPAGSPTSTEEGSPAGSPTSTEEGTST EPSEGSAPGSEPATSGSETPGSEPATSGSETPGTSTEPSEGSAPGSEPATSGSETPGSPAGS PTSTEEGTSESATPESGPGSEPATSGSETPGSEPATSGSETPGTSESATPESGPGTSESATP ESGPGTSTEPSEGSAPGSPAGSPTSTEEGTSESATPESGPGTSTEPSEGSAPGSEPATSGSE TPGSPAGSPTSTEEGTSTEPSEGSAPGTSTEPSEGSAPGSEPATSGSETPGTSESATPESGP GTSTEPSEGSAPGSPAGSPTSTEEGTSESATPESGPGTSESATPESGPGTSTEPSEGSAPGS EPATSGSETPGSEPATSGSETPGTSTEPSEGSAPGTSESATPESGPGSPAGSPTSTEEGTST | 103 |

TABLE 4-continued

XTEN Polypeptides

| XTEN Name | Amino Acid Sequence | SEQ ID NO: |
|---|---|---|
| | EPSEGSAPGTSTEPSEGSAPGSPAGSPTSTEEGSPAGSPTSTEEGTSTEPSEGSAPGSEPAT SGSETPGSPAGSPTSTEEGTSESATPESGPGSEPATSGSETPGSEPATSGSETPGTSESATP ESGPGTSESATPESGPGTSTEPSEGSAPGTST | |
| AE1428 | GSEPATSGSETPGSPAGSPTSTEEGTSTEPSEGSAPGSEPATSGSETPGTSESATPESGPGT STEPSEGSAPGTSESATPESGPGSPAGSPTSTEEGTSTEPSEGSAPGTSTEPSEGSAPGSPA GSPTSTEEGTSTEPSEGSAPGTSESATPESGPGSEPATSGSETPGTSESATPESGPGSEPAT SGSETPGTSTEPSEGSAPGTSTEPSEGSAPGSEPATSGSETPGTSTEPSEGSAPGTSTEPSE GSAPGSPAGSPTSTEEGTSTEPSEGSAPGTSESATPESGPGTSESATPESGPGTSTEPSEGS APGTSTEPSEGSAPGSPAGSPTSTEEGSPAGSPTSTEEGTSTEPSEGSAPGSEPATSGSETP GSPAGSPTSTEEGTSTEPSEGSAPGSPAGSPTSTEEGSPAGSPTSTEEGTSESATPESGPGS EPATSGSETPGSEPATSGSETPGTSTEPSEGSAPGSPAGSPTSTEEGSPAGSPTSTEEGTSE SATPESGPGSEPATSGSETPGSEPATSGSETPGTSESATPESGPGSEPATSGSETPGSEPAT SGSETPGTSESATPESGPGTSESATPESGPGTSESATPESGPGTSESATPESGPGSPAGSPT STEEGTSTEPSEGSAPGTSESATPESGPGTSTEPSEGSAPGTSTEPSEGSAPGTSESATPES GPGTSTEPSEGSAPGTSESATPESGPGSPAGSPTSTEEGTSTEPSEGSAPGSEPATSGSETP GTSTEPSEGSAPGSEPATSGSETPGTSTEPSEGSAPGTSTEPSEGSAPGSPAGSPTSTEEGT SESATPESGPGTSTEPSEGSAPGSEPATSGSETPGTSESATPESGPGTSESATPESGPGTSE SATPESGPGTSTEPSEGSAPGSEPATSGSETPGSPAGSPTSTEEGTSESATPESGPGTSTEP SEGSAPGTSTEPSEGSAPGSPAGSPTSTEEGTSESATPESGPGTSTEPSEGSAPGTSTEPSE GSAPGSPAGSPTSTEEGTSESATPESGPGSPA | 104 |
| AE1524 | GTSTEPSEGSAPGTSTEPSEGSAPGTSTEPSEGSAPGTSTEPSEGSAPGSPAGSPTSTEEGS PAGSPTSTEEGTSESATPESGPGSEPATSGSETPGTSTEPSEGSAPGTSESATPESGPGTST EPSEGSAPGTSESATPESGPGTSESATPESGPGSPAGSPTSTEEGTSTEPSEGSAPGSEPAT SGSETPGTSTEPSEGSAPGSPAGSPTSTEEGTSTEPSEGSAPGSPAGSPTSTEEGSPAGSPT STEEGSPAGSPTSTEEGTSESATPESGPGSEPATSGSETPGSPGTSESATPES GPGSPAGSPTSTEEGTSTEPSEGSAPGSEPATSGSETPGTSTEPSEGSAPGSPAGSPTSTEE GSPAGSPTSTEEGTSTEPSEGSAPGSEPATSGSETPGSPAGSPTSTEEGTSESATPESGPGS EPATSGSETPGSPAGSPTSTEEGTSESATPESGPGTSESATPESGPGTSTEPSEGSAPGSEP ATSGSETPGSEPATSGSETPGTSESATPESGPGSEPATSGSETPGTSTEPSEGSAPGSPAGS PTSTEEGTSTEPSEGSAPGSEPATSGSETPGSEPATSGSETPGSPAGSPTSTEEGTSESATP ESGPGTSTEPSEGSAPGSPAGSPTSTEEGSPAGSPTSTEEGTSESATPESGPGSPAGSPTST EEGTSTEPSEGSAPGSEPATSGSETPGSEPATSGSETPGSEPATSGSETPGTSESATPESGP GTSESATPESGPGTSTEPSEGSAPGTSTEPSEGSAPGSEPATSGSETPGTSTEPSEGSAPGT SESATPESGPGSPAGSPTSTEEGSPAGSPTSTEEGTSTEPSEGSAPGSEPATSGSETPESGPGSA GSPTSTEEGTSTEPSEGSAPGSEPATSGSETPGTSESATPESGPGSEPATSGSETPGTSESA TPESGPGSEPATSGSETPGSEPATSGSETPGTSTEPSEGSAPGTSESATPESGPGTSTEPSE GSAPGTSTEPSEGSAPGTSESATPESGPGSPA | 105 |
| AE1620 | GSEPATSGSETPGTSTEPSEGSAPGSEPATSGSETPGTSTEPSEGSAPGTSESATPESGPGT SESATPESGPGSEPATSGSETPGTSTEPSEGSAPGTSTEPSEGSAPGTSESATPESGPGTST EPSEGSAPGTSTEPSEGSAPGSEPATSGSETPGSPAGSPTSTEEGTSESATPESGPGTSESA TPESGPGTSTEPSEGSAPGTSESATPESGPGSEPATSGSETPGTSESATPESGPGTSESATP ESGPGTSTEPSEGSAPGTSTEPSEGSAPGSEPATSGSETPGSPAGSPTSTEEGTSESATPES GPGSEPATSGSETPGSEPATSGSETPGTSESATPESGPGTSESATPESGPGSPAGSPTSTEE GTSTEPSEGSAPGTSESATPESGPGTSTEPSEGSAPGTSTEPSEGSAPGTSESATPESGPGT STEPSEGSAPGSPAGSPTSTEEGSPAGSPTSTEEGTSESATPESGPGSEPATSGSETPGSEP ATSGSETPGTSTEPSEGSAPGTSESATPESGPGSPAGSPTSTEEGSPAGSPTSTEEGTSTEP SEGSAPGSPAGSPTSTEEGSPAGSPTSTEEGTSESATPESGPGSEPATSGSETPGTSTEPSE GSAPGTSTEPSEGSAPGSEPATSGSETPGSPAGSPTSTEEGTSESATPESGPGSPAGSPTST EEGTSTEPSEGSAPGTSESATPESGPGSEPATSGSETPGTSESATPESGPGTSESATPESGP GSPAGSPTSTEEGTSTEPSEGSAPGSEPATSGSETPGSPAGSPTSTEEGTSTEPSEGSAPGS EPATSGSETPGSEPATSGSETPGTSESATPESGPGTSESATPESGPGTSTEPSEGSAPGTSE SATPESGPGSEPATSGSETPGTSESATPESGPGTSESATPESGPGTSTEPSEGSAPGTSESA TPESGPGSEPATSGSETPGTSTEPSEGSAPGSPAGSPTSTEEGTSESATPESGPGTSTEPSE GSAPGTSTEPSEGSAPGSPAGSPTSTEEGTST | 106 |
| AE1716 | GTSESATPESGPGTSTEPSEGSAPGTSESATPESGPGTSTEPSEGSAPGSEPATSGSETPGS PAGSPTSTEEGTSESATPESGPGSEPATSGSETPGSEPATSGSETPGTSESATPESGPGTSE SATPESGPGTSTEPSEGSAPGSEPATSGSETPGSEPATSGSETPGTSESATPESGPGTSESA TPESGPGSEPATSGSETPGTSESATPESGPGSPAGSPTSTEEGSPAGSPTSTEEGTSTEPSE GSAPGSEPATSGSETPGSPAGSPTSTEEGTSESATPESGPGSPAGSPTSTEEGTSTEPSEGS APGSEPATSGSETPGSPAGSPTSTEEGTSESATPESGPGSPAGSPTSTEEGSPAGSPTSTEE GTSTEPSEGSAPGSEPATSGSETPGSPAGSPTSTEEGTSESATPESGPGTSTEPSEGSAPGS PAGSPTSTEEGTSESATPESGPGSPATSGSETPGTSTEPSEGSAPGTSTEPSEGSAPGSEPAT SGSETPGTSESATPESGPGTSESATPESGPGTSTEPSEGSAPGTSTEPSEGSAPGSPAGSPT STEEGSPAGSPTSTEEGTSTEPSEGSAPGSEPATSGSETPGSEPATSGSETPGTSESATPES GPGSPAGSPTSTEEGTSESATPESGPGTSTEPSEGSAPGTSTEPSEGSAPGSPAGSPTSTEE GSPAGSPTSTEEGTSESATPESGPGSPAGSPTSTEEGTSTEPSEGSAPGSEPATSGSETPGS PAGSPTSTEEGSPAGSPTSTEEGTSTEPSEGSAPGTSESATPESGPGTSESATPESGPGSPA | 107 |

TABLE 4-continued

XTEN Polypeptides

| XTEN Name | Amino Acid Sequence | SEQ ID NO: |
|---|---|---|
| | GSPTSTEEGTSTEPSEGSAPGSPAGSPTSTEEGTSTEPSEGSAPGSPAGSPTSTEEGTSTEP SEGSAPGTSTEPSEGSAPGSEPATSGSETPGSPAGSPTSTEEGTSESATPESGPGSEPATSG SETPGSPAGSPTSTEEGTSESATPESGPGTSE | |
| AE1812 | GTSESATPESGPGSPAGSPTSTEEGSPAGSPTSTEEGTSESATPESGPGSEPATSGSETPGT STEPSEGSAPGTSTEPSEGSAPGTSTEPSEGSAPGSPAGSPTSTEEGTSTEPSEGSAPGTSE SATPESGPGTSESATPESGPGSPAGSPTSTEEGSPAGSPTSTEEGSPAGSPTSTEEGTSESA TPESGPGSEPATSGSETPGTSESATPESGPGTSTEPSEGSAPGTSESATPESGPGTSTEPSE GSAPGTSTEPSEGSAPGTSESATPESGPGSPAGSPTSTEEGTSESATPESGPGTSTEPSEGS APGSPAGSPTSTEEGTSESATPESGPGSEPATSGSETPGTSTEPSEGSAPGSEPATSGSETP GSEPATSGSETPGTSESATPESGPGTSESATPESGPGTSTEPSEGSAPGTSESATPESGPGS PAGSPTSTEEGTSTEPSEGSAPGSEPATSGSETPGTSESATPESGPGSEPATSGSETPGTST EPSEGSAPGTSESATPESGPGSPAGSPTSTEEGSPAGSPTSTEEGSPAGSPTSTEEGTSESA TPESGPGSEPATSGSETPGTSESATPESGPGTSESATPESGPGSEPATSGSETPGTSTEPSE GSAPGTSTEPSEGSAPGTSTEPSEGSAPGTSESATPESGPGSEPATSGSETPGTSESATPES GPGSEPATSGSETPGTSTEPSEGSAPGSEPATSGSETPGSPAGSPTSTEEGTSESATPESGP GTSESATPESGPGTSESATPESGPGSPAGSPTSTEEGTSTEPSEGSAPGTSESATPESGPGT SESATPESGPGTSTEPSEGSAPGTSTEPSEGSAPGSPAGSPTSTEEGTSESATPESGPGSEP ATSGSETPGTSESATPESGPGTSESATPESGPGTSTEPSEGSAPGSEPATSGSETPGTSESA TPESGPGSPAGSPTSTEEGTSTEPSEGSAPGSEPATSGSETPGSPAGSPTSTEEGTSESATP ESGPGSPAGSPTSTEEGTSTEPSEGSAPGSEP | 108 |
| AE1908 | GSEPATSGSETPGTSTEPSEGSAPGTSESATPESGPGSEPATSGSETPGTSTEPSEGSAPGS PAGSPTSTEEGTSESATPESGPGSPAGSPTSTEEGTSTEPSEGSAPGSEPATSGSETPGTST EPSEGSAPGTSESATPESGPGTSEPATSGSETPGSEPATSGSETPGTSESATPESGPGTSTEP SEGSAPGTSESATPESGPGTSESATPESGPGSPAGSPTSTEEGSPAGSPTSTEEGTSESATP ESGPGTSESATPESGPGTSTEPSEGSAPGTSTEPSEGSAPGSPAGSPTSTEEGTSTEPSEGS APGSEPATSGSETPGSEPATSGSETPGSEPATSGSETPGSEPATSGSETPGTSESATPESGP GTSESATPESGPGTSESATPESGPGTSTEPSEGSAPGTSESATPESGPGTSESATPESGPGT STEPSEGSAPGSPAGSPTSTEEGTSTEPSEGSAPGSEPATSGSETPGSPAGSPTSTEEGTSE SATPESGPGTSTEPSEGSAPGSEPATSGSETPGTSESATPESGPGTSESATPESGPGTSTEP SEGSAPGSEPATSGSETPGSPAGSPTSTEEGTSESATPESGPGTSESATPESGPGTSTEPSE GSAPGSEPATSGSETPGSPAGSPTSTEEGTSESATPESGPGSEPATSGSETPGTSTEPSEGS APGSEPATSGSETPGSPAGSPTSTEEGTSESATPESGPGTSTEPSEGSAPGSEPATSGSETP GTSESATPESGPGTSESATPESGPGSPAGSPTSTEEGTSTEPSEGSAPGSPAGSPTSTEEGS PAGSPTSTEEGSPAGSPTSTEEGTSESATPESGPGSEPATSGSETPGTSTEPSEGSAPGTST EPSEGSAPGTSESATPESGPGTSTEPSEGSAPGTSESATPESGPGSEPATSGSETPGTSTEP SEGSAPGTSESATPESGPGSPAGSPTSTEEGSPAGSPTSTEEGSPAGSPTSTEEGTSESATP ESGPGSPAGSPTSTEEGTSESATPESGPGSEP | 109 |
| AE2004A | GTSTEPSEGSAPGSEPATSGSETPGTSTEPSEGSAPGTSTEPSEGSAPGSEPATSGSETPGS PAGSPTSTEEGSPAGSPTSTEEGTSESATPESGPGSEPATSGSETPGTSTEPSEGSAPGTST EPSEGSAPGSPAGSPTSTEEGTSESATPESGPGTSESATPESGPGSPAGSPTSTEEGTSTEP SEGSAPGTSESATPESGPGTSTEPSEGSAPGSEPATSGSETPGTSESATPESGPGSEPATSG SETPGTSTEPSEGSAPGTSTEPSEGSAPGSPAGSPTSTEEGSPAGSPTSTEEGTSESATPES GPGSPAGSPTSTEEGTSTEPSEGSAPGSEPATSGSETPGSEPATSGSETPGSPAGSPTSTEE GTSESATPESGPGTSTEPSEGSAPGSEPATSGSETPGTSESATPESGPGSEPATSGSETPGS PAGSPTSTEEGTSESATPESGPGTSESATPESGPGSEPATSGSETPGTSESATPESGPGTSE SATPESGPGTSESATPESGPGTSTEPSEGSAPGTSESATPESGPGSEPATSGSETPGTSTEP SEGSAPGSPAGSPTSTEEGTSTEPSEGSAPGSEPATSGSETPGSPAGSPTSTEEGTSESATP ESGPGTSESATPESGPGTSTEPSEGSAPGTSESATPESGPGTSTEPSEGSAPGTSESATPES GPGSEPATSGSETPGTSTEPSEGSAPGTSTEPSEGSAPGSPAGSPTSTEEGSPAGSPTSTEE GTSESATPESGPGTSTEPSEGSAPGTSESATPESGPGSPAGSPTSTEEGSPAGSPTSTEEGS PAGSPTSTEEGTSTEPSEGSAPGSPAGSPTSTEEGSPAGSPTSTEEGTSESATPESGPGSEP ATSGSETPGSEPATSGSETPGTSESATPESGPGSEPATSGSETPGTSESATPESGPGTSTEP SEGSAPGTSTEPSEGSAPGSPAGSPTSTEEGSPAGSPTSTEEGTSESATPESGPGSPAGSPT STEEGTSTEPSEGSAPGTSESATPESGPGTSE | 110 |
| AG948 | GSSTPSGATGSPGTPGSGTASSSPGASPGTSSTGSPGSSPSASTGTGPGTPGSGTASSSPG TPGSGTASSSPGTPGSGTASSSPGSSPSASTGTGPGTPGSGTASSSPGSSPSASTGTGPGSS TPSGATGSPGSSTPSGATGSPGSSPSASTGTGPGSSPSASTGTGPGASPGTSSTGSPGASP GTSSTGSPGSSPSASTGTGPGSSPSASTGTGPGASPGTSSTGSPGSSPSASTGTGPGASPG TSSTGSPGSSPSASTGTGPGASPGTSSTGSPGTPGSGTASSSPGTPGSGTASSSPGSSTPSG ATGSPGSSTPSGATGSPGSSTPSGATGSPGASPGTSSTGSPGSSPSASTGTGPGASPGTSS TGSPGASPGTSSTGSPGSSTPSGATGSPGSSPSASTGTGPGTPGSGTAS SSPGASPGTSSTGSPGTPGSGTASSSPGSSTPSGATGSPGSSTPSGATGSPGSSPSASTGTGT PGSSPSASTGTGPGSSTPSGATGSPGASPGTSSTGSPTPGSGTASSSPGSSPSASTGTGP GSSTPSGATGSPGASPGTSSTGSPGSSTPSGATGSPGTPGSGTASSSPGSSPSASTGTGPG SSTPSGATGSPGSSTPSGASPGTSSTGSPGTPGSGTASSSPGSSPSASTGTASSSPGSS PSASTGTGPGASPGTSSTGSPGASPGTSSTGSPGTPGSGTASSSPGTPGSGTASSSPGSSTP SGATGSPGSSPSASTGTGPGSSTPSGATGSPGSSPSASTGTGPGSSPSASTGTGPGTPGSG TASSSPGSSTPSGATGSPGASPGTSSTGSPGTPGSGTASSSPGTPGSGTASSSPGSSTPSGA TGSPGTPGSGTASSSPGASPGTSSTGSPGSSTPSGATGSPGSSTPSGATGSPGTPGSGTAS SSPGSSTPSGATGSPGSSTPSGATGSP | 111 |

TABLE 4-continued

XTEN Polypeptides

| XTEN Name | Amino Acid Sequence | SEQ ID NO: |
|---|---|---|
| AG1044 | GTPGSGTASSSPGTPGSGTASSSPGSSPSASTGTGPGTPGSGTASSSPGASPGTSSTGSPG<br>TPGSGTASSSPGSSPSASTGTGPGSSTPSGATGSPGASPGTSSTGSPGASPGTSSTGSPGSS<br>PSASTGTGPGSSTPSGATGSPGSSPSASTGTGPGSSPSASTGTGPGTPGSGTASSSPGTPG<br>SGTASSSPGASPGTSSTGSPGSSTPSGATGSPGSSPSASTGTGPGTPGSGTASSSPGASPG<br>TSSTGSPGTPGSGTASSSPGSSPSASTGTGPGSSPSASTGTGPGASPGTSSTGSPGASPGTS<br>STGSPGSSTPSGATGSPGSSTPSGATGSPGTPGSGTASSSPGSSPSASTGTGPGSSTPSGAT<br>GSPGASPGTSSTGSPGSSTPSGATGSPGSSTPSGATGSPGSSPSASTGTGPGASPGTSSTG<br>SPGTPGSGTASSSPGASPGTSSTGSPGSSPSASTGTGPGTPGSGTASSSPGASPGTSSTGSP<br>GASPGTSSTGSPGSSTPSGATGSPGTPGSGTASSSPGSSTPSGATGSPGASPGTSSTGSPG<br>TPGSGTASSSPGTPGSGTASSSPGSSTPSGATGSPGSSPGTPGSGTASSSPGSS<br>TPSGATGSPGSSTPSGATGSPGASPGTSSTGSPGSSPSASTGTGPGSSPSASTGTGPGASP<br>GTSSTGSPGASPGTSSTGSPGTPGSGTASSSPGSSPSASTGTGPGTPGSGTASSSPGSSTPS<br>GATGSPGSSTPSGATGSPGASPGTSSTGSPGSSPSASTGTGPGASPGTSSTGSPGSSPSAS<br>TGTGPGSSPSASTGTGPGASPGTSSTGSPGASPGTSSTGSPGSSTPSGATGSPGASPGTSS<br>TGSPGASPGTSSTGSPGTPGSGTASSSPGTPGSGTASSSPGTPGSGTASSSPGSSTPSGAT<br>GSPGSSTPSGATGSPGSSPSASTGTGPGSSPSASTGTGPGTPGSGTASSSPGSSPSASTGT<br>GPGASPGTSSTGSPGSSTPSGATGSPGTPGSGTASSSPGSST | 112 |
| AG1140 | GASPGTSSTGSPGSSPSASTGTGPGSSTPSGATGSPGASPGTSSTGSPGASPGTSSTGSPG<br>SSTPSGATGSPGTPGSGTASSSPGASPGTSSTGSPGTPGSGTASSSPGTPGSGTASSSPGSS<br>TPSGATGSPGSSTPSGATGSPGTPGSGTASSSPGSSTPSGATGSPGSSTPSGATGSPGSSPS<br>ASTGTGPGSSPSASTGTGPGASPGTSSTGSPGTPGSGTASSSPGASPGTSSTGSPGSSTPS<br>GATGSPGTPGSGTASSSPGSSPSASTGTGPGSSTPSGATGSPGSSPSASTGTGPGSSTPSG<br>ATGSPGASPGTSSTGSPGSSPSASTGTGPGTPGSGTASSSPGASPGTSSTGSPGSSTPSGA<br>TGSPGASPGTSSTGSPGSSPSASTGTGPGTPGSGTASSSPGTPGSGTASSSPGASPGTSST<br>GSPGTPGSGTASSSPGTPGSGTASSSPGSSPSASTGTGPGASPGTSSTGSPGSSTPSGATG<br>SPGASPGTSSTGSPGSSPSASTGTGPGTPGSGTASSSPGSSPSASTGTGPGSSPSASTGTGP<br>GASPGTSSTGSPGASPGTSSTGSPGTPGSGTASSSPGASPGTSSTGSPGASPGTSSTGSPG<br>TPGSGTASSSPGTPGSGTASSSPGSSTPSGATGSPGSSTPSGATGSPGTPGSGTASSSPGSS<br>PSASTGTGPGTPGSGTASSSPGSSTPSGATGSPGSSTPSGATGSPGASPGTSSTGSPGTPG<br>SGTASSSPGASPGTSSTGSPGSSTPSGATGSPGASPGSSTPSGATGSPGTPGSGTASSSPGSSTPS<br>GATGSPGSSTPSGATGSPGASPGTSSTGSPGSSPSASTGTGPGSSTPSGATGSPGSSTPSG<br>ATGSPGSSPSASTGTGPGSSPSASTGTGPGSSTPSGATGSPGASPGTSSTGSPGSSPSAST<br>GTGPGTPGSGTASSSPGASPGTSSTGSPGSSPSASTGTGPGASPGTSSTGSPGSSTPSGAT<br>GSPGSSPSASTGTGPGSSPSASTGTGPGASPGTSSTGSPGSST | 113 |
| AG1236 | GSSPSASTGTGPGTPGSGTASSSPGSSPSASTGTGPGSSPSASTGTGPGTPGSGTASSSPG<br>ASPGTSSTGSPGSSTPSGATGSPGTPGSGTASSSPGASPGTSSTGSPGTPGSGTASSSPGTP<br>GSGTASSSPGSSPSASTGTGPGSSPSASTGTGPGSSTPSGATGSPGASPGTSSTGSPGSSPS<br>ASTGTGPGTPGSGTASSSPGTPGSGTASSSPGSSTPSGATGSPGASPGTSSTGSPGSSPSA<br>STGTGPGTPGSGTASSSPGTPGSGTASSSPGASPGTSSTGSPGSSTPSGATGSPGSSTPSG<br>ATGSPGSSPSASTGTGPGSSPSASTGTGPGASPGTSSTGSPGSSPSASTGTGPGSSTPSGA<br>TGSPGASPGTSSTGSPGASPGTSSTGSPGSSTPSGATGSPGSSPSASTGTGPGASPGTSST<br>GSPGASPGTSSTGSPGTPGSGTASSSPGSSTPSGATGSPGASPGTSSTGSPGSSTPSGATG<br>SPGTPGSGTASSSPGSSPSASTGTGPGSSTPSGATGSPGTPGSGTASSSPGSSTPSGATGSP<br>GSSTPSGATGSPGASPGTSSTGSPGSSPSASTGTGPGSSPSASTGTGPGASPGTSSTGSPG<br>SSPSASTGTGPGTPGSGTASSSPGTPGSGTASSSPGASPGTSSTGSPGTPGSGTASSSPGA<br>SPGTSSTGSPGTPGSGTASSSPGASPGTSSTGSPGSSTPSGATGSPGASPGTSSTGSPGSSP<br>SASTGTGPGTPGSGTASSSPGTPGSGTASSSPGSSPSASTGTGPGTPGSGTASSSPGASPG<br>TSSTGSPGSSTPSGATGSPGTPGSGTASSSPGASPGTSSTGSPGTPGSGTASSSPGTPGSG<br>TASSSPGSSTPSGATGSPGTPGSGTASSSPGSSPSASTGTGPGASPGTSSTGSPGTPGSGT<br>ASSSPGSSTPSGATGSPGSSTPSGATGSPGSSPSASTGTGPGASPGTSSTGSPGTPGSGTA<br>SSSPGSSPSASTGTGPGSSPSASTGTGPGASPGTSSTGSPGASP | 114 |
| AG1332 | GSSTPSGATGSPGSSPSASTGTGPGTPGSGTASSSPGSSPSASTGTGPGASPGTSSTGSPG<br>SSPSASTGTGPGTPGSGTASSSPGASPGTSSTGSPGSSTPSGATGSPGSSTP<br>SGATGSPGASPGTSSTGSPGTPGSGTASSSPGASPGTSSTGSPGSSTPSGATGSPGSSTP<br>SGATGSPGSSPSASTGTGPGTPGSGTASSSPGSSTPSGATGSPGSSTPSGATGSPGSSPSA<br>STGTGPGTPGSGTASSSPGASPGTSSTGSPGTPGSGTASSSPGASPGTSSTGSPGASPGTS<br>STGSPGTPGSGTASSSPGTPGSGTASSSPGSSTPSGATGSPGSSTPSGATGSPGSSTPSGAT<br>GSPGASPGTSSTGSPGSSPSASTGTGPGSSTPSGATGSPGASPGTSSTGSPGASPGTSSTGSPGASPGTSSTGSPGASPGTSSTGSPGASPGTSSTGSPGASPGTSSTGSP<br>SPGTPGSGTASSSPGSSPSASTGTGPGSSTPSGATGSPGASPGTSSTGSPGASPGTSSTGSP<br>GSSPSASTGTGPGASPGTSSTGSPGSSTPSGATGSPGASPGTSSTGSPGTPGSGTASSSPG<br>TPGSGTASSSPGSSPSASTGTGPGTPGSGTASSSPGSSTPSGATGSPGSSPSASTGTGPGSS<br>TPSGATGSPGTPGSGTASSSPGTPGSGTASSSPGSSPSASTGTGPGSSTPSGATGSPGSSTP<br>SGATGSPGSSPSASTGTGPGSSPSASTGTGPGASPGTSSTGSPGSSTPS<br>GATGSPGASPGTSSTGSPGSSPSASTGTGPGTPGSGTASSSPGASPGTSSTGSPGASPGTS<br>STGSPGTPGSGTASSSPGTPGSGTASSSPGSSPSASTGTGPGTPGSGTASSSPGASPGTSST<br>GSPGSSTPSGATGSPGTPGSGTASSSPGTPGSGTASSSPGSSTPSGATGSPGSSTPSGATG<br>SPGTPGSGTASSSPGSSPSASTGTGPGSSPSASTGTGPGASPGTSSTGSPGSSPSASTGTGP<br>GSSPSASTGTGPGASPGTSSTGSPGASPGTSSTGSPGTPG | 115 |

TABLE 4-continued

XTEN Polypeptides

| XTEN Name | Amino Acid Sequence | SEQ ID NO: |
|---|---|---|
| AG1428 | GTPGSGTASSSPGSSTPSGATGSPGASPGTSSTGSPGSSTPSGATGSPGTPGSGTASSSPG<br>TPGSGTASSSPGSSTPSGATGSPGSSTPSGATGSPGASPGTSSTGSPGSSPSASTGTGPGSS<br>TPSGATGSPGASPGTSSTGSPGSSPSASTGTGPGTPGSGTASSSPGASPGTSSTGSPGASP<br>GTSSTGSPGTPGSGTASSSPGTPGSGTASSSPGASPGTSSTGSPGASPGTSSTGSPGTPGS<br>GTASSSPGTPGSGTASSSPGSSPSASTGTGPGSSPSASTGTGPGASPGTSSTGSPGSSPSAS<br>TGTGPGSSPSASTGTGPGASPGTSSTGSPGASPGTSSTGSPGTPGSGTASSSPGTPGSGTA<br>SSSPGSSPSASTGTGPGASPGTSSTGSPGSSTPSGATGSPGASPGTSSTGSPGSSPSASTGT<br>GPGSSTPSGATGSPGSSPSASTGTGPGSSPSASTGTGPGASPGTSSTGSPGSSPSASTGTG<br>PGSSPSASTGTGPGASPGTSSTGSPGASPGTSSTGSPGSSPSASTGTGPGTPGSGTASSSP<br>GASPGTSSTGSPGSSTPSGATGSPGTPGSGTASSSPGTPGSGTASSSPGSSPSASTGTGPG<br>SSTPSGATGSPGASPGTSSTGSPGASPGTSSTGSPGSSTPSGATGSPGSSPSASTGTGPGA<br>SPGTSSTGSPGSSTPSGATGSPGTPGSGTASSSPGASPGTSSTGSPGTPGSGTASSSPGASP<br>GTSSTGSPGSSTPSGATGSPGSSTPSGATGSPGASPGTSSTGSPGSSPSASTGTGPGTPGS<br>GTASSSPGTPGSGTASSSPGSSTPSGATGSPGTPGSGTASSSPGASPGTSSTGSPGSSTPSG<br>ATGSPGTPGSGTASSSPGSSPSASTGTGPGSSTPSGATGSPGSSTPSGATGSPGSSPSAST<br>GTGPGSSTPSGATGSPGTPGSGTASSSPGSSPSASTGTGPGTPGSGTASSSPGSSTPSGAT<br>GSPGSSPSASTGTGPGSSPSASTGTGPGTPGSGTASSSPGASP | 116 |
| AG1524 | GSSTPSGATGSPGTPGSGTASSSPGTPGSGTASSSPGASPGTSSTGSPGSSTPSGATGSPG<br>TPGSGTASSSPGSSTPSGATGSPGSSPSASTGTGPGSSTPSGATGSPGTPGSGTASSSPGTP<br>GSGTASSSPGSSPSASTGTGPGSSTPSGATGSPGSSPSASTGTGPGTPGSGTASSSPGASP<br>GTSSTGSPGSSTPSGATGSPGASPGTSSTGSPGTPGSGTASSSPGSSTPSGATGSPGTPGS<br>GTASSSPGSSPSASTGTGPGASPGTSSTGSPGASPGTSSTGSPGTPGSGTASSSPGSSTPSG<br>ATGSPGSSTPSGATGSPGSSPSASTGTGPGSSPSASTGTGPGASPGTSSTGSPGTPGSGTA<br>SSSPGTPGSGTASSSPGSSPSASTGTGPGASPGTSSTGSPGASPGTSSTGSPGTPGSGTASS<br>SPGSSPSASTGTGPGASPGTSSTGSPGASPGTSSTGSPGSSTPSGATGSPGSSPSASTGTGP<br>GSSPSASTGTGPGTPGSGTASSSPGTPGSGTASSSPGASPGTSSTGSPGSSTPSGATGSPG<br>TPGSGTASSSPGASPGTSSTGSPGTPGSGTASSSPGTPGSGTASSSPGSSTPSGATGSPGSS<br>TPSGATGSPGTPGSGTASSSPGSSPSASTGTGPGSSTPSGATGSPGSSTPSGATGSPGSSPS<br>ASTGTGPGTPGSGTASSSPGSSPSASTGTGPGASPGTSSTGSPGSSPSASTGTGPGTPGSG<br>TASSSPGASPGTSSTGSPGASPGTSSTGSPGTPGSGTASSSPGTPGSGTASSSPGSSTPSGA<br>TGSPGTPGSGTASSSPGASPGTSSTGSPGSSTPSGATGSPGSSTPSGATGSPGSSTPSGA<br>GSPGTPGSGTASSSPGSSPSASTGTGPGSSPSASTGTGPGSSPSASTGTGPGASPGTSSTG<br>SPGASPGTSSTGSPGSSPSASTGTGPGTPGSGTASSSPGASPGTSSTGSPGSSTPSGATGSP<br>GASPGTSSTGSPGASPGTSSTGSPGSSTPSGATGSPGTPG | 117 |
| AG1620 | GSSTPSGATGSPGSSTPSGATGSPGTPGSGTASSSPGSSPSASTGTGPGTPGSGTASSSPG<br>ASPGTSSTGSPGSSTPSGATGSPGASPGTSSTGSPGTPGSGTASSSPGASPGTSSTGSPGSS<br>PSASTGTGPGTPGSGTASSSPGASPGTSSTGSPGSSTPSGATGSPGSSPSASTGTGPGSSTP<br>SGATGSPGASPGTSSTGSPGASPGTSSTGSPGASPGTSSTGSPGSSTPSGATGSPGASPGT<br>SSTGSPGTPGSGTASSSPGSSTPSGATGSPGSSTPSGATGSPGSSPSASTGTGPGSSPSAST<br>GTGPGSSTPSGATGSPGSSPSASTGTGPGSSPSASTGTGPGASPGTSSTGSPGASPGTSST<br>GSPGTPGSGTASSSPGSSPSASTGTGPGSSPSASTGTGPGASPGTSSTGSPGSSPSASTGT<br>GPGTPGSGTASSSPGSSPSASTGTGPGSSTPSGATGSPGASPGTSSTGSPGSSTPSGATGS<br>PGTPGSGTASSSPGSSPSASTGTGPGASPGTSSTGSPGSSTPSGATGSPGASPGTSSTGSP<br>GASPGTSSTGSPGTPGSGTASSSPGASPGTSSTGSPGASPGTSSTGSPGSSTPSGATGSPG<br>TPGSGTASSSPGSSPSASTGTGPGSSTPSGATGSPGTPGSGTASSSPGSSTPSGATGSPGSS<br>TPSGATGSPGSSPSASTGTGPGSSTPSGATGSPGASPGTSSTGSPGSSPSASTGTGPGSSPS<br>ASTGTGPGTPGSGTASSSPGASPGTSSTGSPGSSPSASTGTGPGSSTPSGATGSPGSSPSA<br>STGTGPGSSTPSGATGSPGSSPSASTGTGPGTPGSGTASSSPGTPGSGTASSSPGSSTPSG<br>ATGSPGSSTPSGATGSPGTPGSGTASSSPGSSPSASTGTGPGSSTPSGATGSPGSSPSAST<br>GTGPGSSPSASTGTGPGSSTPSGATGSPGASPGTSSTGSPGASPGTSSTGSPGTPGSGTAS<br>SSPGTPGSGTASSSPGTPGSGTASSSPGSSTPSGATGSPGSST | 118 |
| AG1716 | GASPGTSSTGSPGSSPSASTGTGPGSSTPSGATGSPGSSPSASTGTGPGTPGSGTASSSPG<br>SSTPSGATGSPGSSTPSGATGSPGSSPSASTGTGPGSSTPSGATGSPGTPGSGTASSSPGSS<br>PSASTGTGPGSSTPSGATGSPGASPGTSSTGSPGSSPSASTGTGPGASPGTSSTGSPGTPG<br>SGTASSSPGASPGTSSTGSPGSSTPSGATGSPGSSPSASTGTGPGASPGTSSTGSPGSSTPS<br>GATGSPGTPGSGTASSSPGSSPSASTGTGPGSSPSASTGTGPGSSPSASTGTGPGTPGSGT<br>ASSSPGTPGSGTASSSPGSSTPSGATGSPGTPGSGTASSSPGSSPSASTGTGPGASPGTSST<br>GSPGASPGTSSTGSPGTPGSGTASSSPGSSPSASTGTGPGASPGTSSTGSPGTPGSGTASS<br>SPGSSTPSGATGSPGSSTPSGATGSPGASPGTSSTGSPGTPGSGTASSSPGSSPSASTGTGP<br>GTPGSGTASSSPGASPGTSSTGSPGSSTPSGATGSPGASPGTSSTGSPGASPGTSSTGSPG<br>TPGSGTASSSPGTPGSGTASSSPGSSPSASTGTGPGSSPSASTGTGPGSSPSASTGTGPGTP<br>GSGTASSSPGASPGTSSTGSPGSSTPSGATGSPGASPGTSSTGSPGSSPSASTGTGPGASP<br>GTSSTGSPGSSPSASTGTGPGASPGTSSTGSPGSSPSASTGTGPGSSPSASTGTGPGTPGS<br>GTASSSPGASPGTSSTGSPGTPGSGTASSSPGTPGSGTASSSPGASPGTSSTGSPGSSTPSG<br>ATGSPGSSTPSGATGSPGSSPSASTGTGPGSSTPSGATGSPGTPGSGTASSSPGSSPSAST<br>GTGPGSSTPSGATGSPGSSTPSGATGSPGSSPSASTGTGPGASPGTSSTGSPGASPGTSST<br>SPGSSPSASTGTGPGASPGTSSTGSPGASPGTSSTGSPGTPG | 119 |
| AG1812 | GSSTPSGATGSPGSSPSASTGTGPGASPGTSSTGSPGASPGTSSTGSPGTPGSGTASSSPG<br>SSPSASTGTGPGASPGTSSTGSPGSSTPSGATGSPGSSTPSGATGSPGASPGTSSTGSPGSS | 120 |

TABLE 4-continued

XTEN Polypeptides

| XTEN Name | Amino Acid Sequence | SEQ ID NO: |
|---|---|---|
| | PSASTGTGPGTPGSGTASSSPGTPGSGTASSSPGASPGTSSTGSPGSSTPSGATGSPGSSTP SGATGSPGSSPSASTGTGPGTPGSGTASSSPGASPGTSSTGSPGSSTPSGATGSPGTPGSG TASSSPGSSPSASTGTGPGSSTPSGATGSPGTPGSGTASSSPGSSPSASTGTGPGTPGSGT ASSSPGASPGTSSTGSPGSSTPSGATGSPGSSTPSGATGSPGTPGSGTASSSPGSSTPSGAT GSPGSSTPSGATGSPGASPGTSSTGSPGASPGTSSTGSPGASPGTSSTGSPGSSTPSGATG SPGTPGSGTASSSPGSSPSASTGTGPGTPGSGTASSSPGASPGTSSTGSPGTPGSGTASSSP GASPGTSSTGSPGSSTPSGATGSPGSSPSASTGTGPGSSTPSGATGSPGTPGSGTASSSPGA ASPGTSSTGSPGASPGTSSTGSPGTPGSGTASSSPGASPGTSSTGSPGSSTPSGATGSPGSS TPSGATGSPGSSPSASTGTGPGASPGTSSTGSPGASPGTSSTGSPGTPGSGTASSSPGTPG SGTASSSPGSSTPSGATGSPGSSPSASTGTGPGSSPSASTGTGPGASPGTSSTGSPGASPG TSSTGSPGSSTPSGATGSPGSSPSASTGTGPGASPGTSSTGSPGSSTPSGATGSPGTPGSG TASSSPGSSPSASTGTGPGASPGTSSTGSPGSSTPSGATGSPGTPGSGTASSSPGSSTPSGA TGSPGSSTPSGATGSPGSSTPSGATGSPGSSPSASTGTGPGSSPSASTGTGPGSSTPSGAT GSPGSSPSASTGTGPGSSPSASTGTGPGSSTPSGATGSPGASPGTSSTGSPGASPGTSSTG SPGTPGSGTASSSPGASPGTSSTGSPGSSTPSGATGSPGASP | |
| AG1908 | GSSPSASTGTGPGSSPSASTGTGPGSSPSASTGTGPGTPGSGTASSSPGSSPSASTGTGPG SSPSASTGTGPGASPGTSSTGSPGSSPSASTGTGPGTPGSGTASSSPGTPGSGTASSSPGA SPGTSSTGSPGTPGSGTASSSPGTPGSGTASSSPGSSPSASTGTGPGSSTPSGATGSPGSSP SASTGTGPGASPGTSSTGSPGSSPSASTGTGPGASPGTSSTGSPGASPGTSSTGSPGTPGS GTASSSPGTPGSGTASSSPGASPGTSSTGSPGTPGSGTASSSPGTPGSGTASSSPGSSPSAS TGTGPGSSTPSGATGSPGASPGTSSTGSPGSSTPSGATGSPGSSPSASTGTGPGSSPSAST GTGPGSSTPSGATGSPGASPGTSSTGSPGSSPSASTGTGPGTPGSGTASSSPGASPGTSST GSPGASPGTSSTGSPGTPGSGTASSSPGTPGSGTASSSPGSSTPSGATGSPGTPGSGTASS SPGASPGTSSTGSPGSSTPSGATGSPGTPGSGTASSSPGSSPSASTGTGPGSSPSASTGTGP GSSTPSGATGSPGASPGTSSTGSPGASPGTSSTGSPGTPGSGTASSSPGTPGSGTASSSPG SSTPSGATGSPGSSPSASTGTGPGSSPSASTGTGPGASPGTSSTGSPGASPGTSSTGSPGSS TPSGATGSPGASPGTSSTGSPGASPGTSSTGSPGTPGSGTASSSPGTPGSGTASSSPGTPG SGTASSSPGSSTPSGATGSPGSSTPSGATGSPGSSPSASTGTGPGSSPSASTGTGPGSSTPS GATGSPGTPGSGTASSSPGSSPSASTGTGPGASPGTSSTGSPGSSTPSGATGSPGSSPSAS TGTGPGSSTPSGATGSPGASPGTSSTGSPGSSPSASTGTGPGTPGSGTASSSPGSSPSAST GTGPGSSTPSGATGSPGASPGTSSTGSPGSSPSASTGTGPGTPGSGTASSSPGSSTPSGAT GSPGSSTPSGATGSPGASPGTSSTGSPGSSPSASTGTGPGSSP | 121 |
| AG2004A | GSSPSASTGTGPGTPGSGTASSSPGSSTPSGATGSPGTPGSGTASSSPGSSTPSGATGSPG SSTPSGATGSPGSSPSASTGTGPGSSPSASTGTGPGSSPSASTGTGPGTPGSGTASSSPGA SPGTSSTGSPGSSTPSGATGSPGTPGSGTASSSPGTPGSGTASSSPGSSTPSGATGSPGSST PSGATGSPGSSPSASTGTGPGASPGTSSTGSPGASPGTSSTGSPGASPGTSSTGSPGASPG TSSTGSPGTPGSGTASSSPGTPGSGTASSSPGSSPSASTGTGPGSSTPSGATGSPGASPGTS STGSPGSSTPSGATGSPGSSTPSGATGSPGSSPSASTGTGPGTPGSGTPGSGTPGSGTA SSSPGSSPSASTGTGPGSSPSASTGTGPGASPGTSSTGSPGASPGTSSTGSPGTPGSGTASS SPGASPGTSSTGSPGTPGSGTASSSPGTPGSGTASSSPGSSTPSGATGSPGTPGSGTASSSP GASPGTSSTGSPGSSTPSGATGSPGSSTPSGATGSPGSSPSASTGTGPGSSTPSGATGSPG SSTPSGATGSPGASPGTSSTGSPGSSPSASTGTGPGTPGSGTASSSPGASPGTSSTGSPGSS PSASTGTGPGTPGSGTASSSPGSSPSASTGTGPGTPGSGTPGSGTPGSGTPGSG GTSSTGSPGTPGSGTASSSPGTPGSGTASSSPGSSTPSGATGSPGSSTPSGATGSPGTPGSG GTASSSPGSSTPSGATGSPGSSTPSGATGSPGASPGTSSTGSPGSSPSASTGTGPGSSTPSG ATGSPGSSPSASTGTGPGSSPSASTGTGPGASPGTSSTGSPGSSTPSGATGSPGASPGTSS TGSPGTPGSGTASSSPGTPGSGTASSSPGSSPSASTGTGPGASPGTSSTGSPGSSTPSGAT GSPGSSPSASTGTGPGSSPSASTGTGPGASPGTSSTGSPGTPGSGTASSSPGSSTPSGATG SPGTPGSGTASSSPGSSPSASTGTGPGSSPSASTGTGPGASP | 122 |
| AE72B | SPAGSPTSTEEGSPAGSPTSTEEGTSESATPESGPGTSTEPSEGSAPGTSESATPESGPGSE PATSGSETPG | 123 |
| AE72C | TSESATPESGPGTSESATPESGPGSEPATSGSETPGSEPATSGSETPGSPAGSPTSTEEGTS TEPSEGSAPG | 124 |
| AE108A | TEEGTSESATPESGPGTSTEPSEGSAPGSPAGSPTSTEEGTSTEPSEGSAPGTSTEPSEGSA PGTSESATPESGPGSEPATSGSETPGSEPATSGSETPGSPAGSPTS | 125 |
| AE108B | GSPAGSPTSTEEGTSTEPSEGSAPGTSESATPESGPGTSESATPESGPGTSESATPESGPGS EPATSGSETPGSEPATSGSETPGSPAGSPTSTEEGTSTEPSEGSAP | 126 |
| AE144A | STEPSEGSAPGSPAGSPTSTEEGTSTEPSEGSAPGTSESATPESGPGSEPATSGSETPGTSE SATPESGPGSEPATSGSETPGTSESATPESGPGTSTEPSEGSAPGTSESATPESGPGSPAGS PTSTEEGSPAGSPTSTEEGS | 127 |
| AE144B | SEPATSGSETPGTSESATPESGPGSEPATSGSETPGTSESATPESGPGTSTEPSEGSAPGSP AGSPTSTEEGTSESATPESGPGSEPATSGSETPGTSESATPESGPGSPAGSPTSTEEGSPAG SPTSTEEGTSTEPSEGSAPG | 128 |

TABLE 4-continued

XTEN Polypeptides

| XTEN Name | Amino Acid Sequence | SEQ ID NO: |
|---|---|---|
| AE180A | TSTEEGTSESATPESGPGSEPATSGSETPGTSESATPESGPGSPAGSPTSTEEGSPAGSPTS<br>TEEGTSTEPSEGSAPGTSESATPESGPGTSESATPESGPGTSESATPESGPGSEPATSGSET<br>PGSEPATSGSETPGSPAGSPTSTEEGTSTEPSEGSAPGTSTEPSEGSAPGSEPATS | 129 |
| AE216A | PESGPGTSTEPSEGSAPGSPAGSPTSTEEGTSESATPESGPGSEPATSGSETPGTSESATPE<br>SGPGSPAGSPTSTEEGSPAGSPTSTEEGTSTEPSEGSAPGTSESATPESGPGTSESATPESG<br>PGTSESATPESGPGSEPATSGSETPGSEPATSGSETPGSPAGSPTSTEEGTSTEPSEGSAPG<br>TSTEPSEGSAPGSEPATSGSETPGTSESAT | 130 |
| AE252A | ESGPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSETPGS<br>PAGSPTSTEEGTSTEPSEGSAPGTSTEPSEGSAPGSEPATSGSETPGTSESATPESGPGTST<br>EPSE | 131 |
| AE288A | TPESGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPESGP<br>GTSESATPESGPGTSESATPESGPGSEPATSGSETPGSEPATSGSETPGSPAGSPTSTEEGT<br>STEPSEGSAPGTSTEPSEGSAPGSEPATSGSETPGTSESA | 132 |
| AE324A | PESGPGSPAGSPTSTEEGSPAGSPTSTEEGSPAGSPTSTEEGTSESATPESGPGTSTEPSEG<br>SAPGTSESATPESGPGSEPATSGSETPGTSESATPESGPGTSESATPESGPGTSESATPESG<br>PGTSTEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESGPGTS<br>ESATPESGPGSEPATSGSETPGSEPATSGSETPGSPAGSPTSTEEGTSTEPSEGSAPGTSTE<br>PSEGSAPGSEPATS | 133 |
| AE360A | PESGPGTSTEPSEGSAPGTSESATPESGPGSPAGSPTSTEEGSPAGSPTSTEEGSPAGSPTS<br>TEEGTSESATPESGPGTSTEPSEGSAPGTSESATPESGPGSEPATSGSETPGTSESATPESG<br>PGSEPATSGSETPGTSESATPESGPGTSTEPSEGSAPGSPAGSPTSTEEGTSESATPESGPG<br>SEPATSGSETPGTSESATPESGPGSPAGSPTSTEEGSPAGSPTSTEEGTSTEPSEGSAPGTS<br>ESATPESGPGTSESATPESGPGTSESATPESGPGSEPATSGSETPGSEPATSGSETPGSPAG<br>SPTSTEEGTSTEPSEGSAPGTSTEPSEGSAPGSEPATSGSETPGTSESAT | 134 |
| AE396A | PESGPGSEPATSGSETPGTSESATPESGPGTSTEPSEGSAPGTSESATPESGPGSPAGSPTS<br>TEEGSPAGSPTSTEEGSPAGSPTSTEEGTSESATPESGPGTSTEPSEGSAPGTSESATPESG<br>PGSEPATSGSETPGTSESATPESGPGSEPATSGSETPGTSESATPESGPGTSTEPSEGSAPG<br>SPAGSPTSTEEGTSESATPESGPGSEPATSGSETPGTSESATPESGPGSPAGSPTSTEEGSP<br>AGSPTSTEEGTSTEPSEGSAPGTSESATPESGPGTSESATPESGPGTSESATPESGPGSEPA<br>TSGSETPGSEPATSGSETPGSPAGSPTSTEEGTSTEPSEGSAPGTSTEPS | 135 |
| AE432A | EGSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTSTE<br>EGSPAGSPTSTEEGSPAGSPTSTEEGTSESATPESGPGTSTEPSEGSAPGTSESATPESGPG<br>SEPATSGSETPGTSESATPESGPGSEPATSGSETPGTSESATPESGPGTSTEPSEGSAPGSP<br>AGSPTSTEEGTSESATPESGPGSEPATSGSETPGTSESATPESGPGSPAGSPTSTEEGSPAG<br>SPTSTEEGTSTEPSEGSAPGTSESATPESGPGTSESATPESGPGTSESATPESGPGSEPATS<br>GSETPGSEPATSGSETPGSPAGSPTSTEEGTSTEPSEGSAPGTSTEPSEGSAPGSEPATS | 136 |
| AE468A | EGSAPGTSTEPSEGSAPGTSTEPSEGSAPGSPAGSPTSTEEGTSTEPSEGSAPGTSESATPE<br>SGPGSEPATSGSETPGTSESATPESGPGSEPATSGSETPGTSESATPESGPGTSTEPSEGSA<br>PGTSESATPESGPGSPAGSPTSTEEGSPAGSPTSTEEGSPAGSPTSTEEGTSESATPESGPG<br>TSTEPSEGSAPGTSESATPESGPGSEPATSGSETPGTSESATPESGPGSEPATSGSETPGTS<br>ESATPESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTSESAT<br>PESGPGTSESATPESGPGSEPATSGSETPGSEPATSGSETPGSPAGSPTSTEEGTSTEPSEG<br>SAPGTSTEPSEGSAPGSEPATSGSETPGTSESAT | 137 |
| AE504A | EGSAPGTSTEPSEGSAPGTSTEPSEGSAPGTSTEPSEGSAPGTSTEPSEGSAPGSPAGSPTS<br>TEEGTSTEPSEGSAPGTSESATPESGPGSEPATSGSETPGTSESATPESGPGSEPATSGSET<br>PGTSESATPESGPGTSTEPSEGSAPGTSESATPESGPGSPAGSPTSTEEGSPAGSPTSTEEG<br>SPAGSPTSTEEGTSESATPESGPGTSTEPSEGSAPGTSESATPESGPGSEPATSGSETPGTS<br>ESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPS<br>EGSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTSESATPESG<br>PGTSTEPS | 138 |
| AE540A | TPESGPGSPAGSPTSTEEGTSESATPESGPGSEPATSGSETPGTSESATPESGPGTSTEPSE<br>GSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGS<br>PAGSPTSTEEGSPAGSPTSTEEGTSESATPESGPGTSTEPSEGSAPGTSESATPESGPGSEP | 139 |

TABLE 4-continued

XTEN Polypeptides

| XTEN Name | Amino Acid Sequence | SEQ ID NO: |
|---|---|---|
| | ATSGSETPGTSESATPESGPGSEPATSGSETPGTSESATPESGPGTSTEPSEGSAPGSPAGS PTSTEEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPATSGSE TPGSEPATSGSETPGSPAGSPTSTEEGTSTEPSEGSAPGTSTEP | |
| AE576A | TPESGPGTSESATPESGPGSPAGSPTSTEEGTSESATPESGPGSEPATSGSETPGTSESATP ESGPGTSTEPSEGSAPGTSTEPSEGSAPGTSTEPSEGSAPGTSTEPSEGSAPGTSTEPSEGS APGTSTEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPESGPGS PAGSPTSTEEGSPAGSPTSTEEGSPAGSPTSTEEGTSESATPESGPGTSTEPSEGSAPGTSE SATPESGPGSEPATSGSETPGTSESATPESGPGSEPATSGSETPGTSESATPESGPGTSTEP SEGSAPGSPAGSPTSTEEGTSESATPESGPGSEPATSGSETPGTSESATPESGPGSPAGSPT STEEGSPAGSPTSTEEGTSTEPSEGSAPGTSESATPESGPGTSESATPESGPGTSESATPES GPGSEPATSGSETPGSEPATSGSETPGSPAGSPTSTEEGTSTEPSEGSAPGTSTEPSEGSAP GSEPATSGSETPGTSESA | 140 |
| AE612A | GSETPGTSTEPSEGSAPGTSTEPSEGSAPGTSESATPESGPGTSESATPESGPGSPAGSPTS TEEGTSESATPESGPGSEPATSGSETPGTSESATPESGPGTSTEPSEGSAPGTSTEPSEGSA PGTSTEPSEGSAPGTSTEPSEGSAPGTSTEPSEGSAPGTSPAGSPAGSPTSTEEG TSTEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPAG SPTSTEEGTSESATPESGPGTSTEPSEGSAPGTSESATPESGPGSEPATSGSETPGTSESAT PESGPGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPATSGSETPG SPAGSPTSTEEGTSTEPSEGSAPGTSTEPSEGSAPGSEPATSGSETPGTSESAT | 141 |
| AE648A | PESGPGTSTEPSEGSAPGTSESATPESGPGSEPATSGSETPGTSTEPSEGSAPGTSTEPSEG SAPGTSESATPESGPGTSESATPESGPGSPAGSPTSTEEGTSESATPESGPGSEPATSGSET PGTSESATPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATPESGPGSE PATSGSETPGTSESATPESGPGSEPATSGSETPGTSESATPESGPGTSTEPSEGSAPGTSES ATPESGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSESATPE SGPGTSTEPSEGSAPGSPAGSPTSTEEGTSESATPESGPGSEPATSGSETPGTSESATPESG PGSPAGSPTSTEEGSPAGSPTSTEEGTSTEPSEGSAPGTSESATPESGPGTSESATPESGPG TSESATPESGPGSEPATSGSETPGSEPATSGSETPGSPAGSPTSTEEGTSTEPSEGSAPGTS TEPSEGSAPGSEPATSGSETPGTSESAT | 142 |
| AE684A | EGSAPGSPAGSPTSTEEGTSTEPSEGSAPGTSTEPSEGSAPGTSESATPESGPGTSTEPSEG SAPGTSESATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESATPESGPG TSTEPSEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSPAGSP TSTEEGSPAGSPTSTEEGSPAGSPTSTEEGTSESATPESGPGTSTEPSEGSAPGTSESATPE SGPGSEPATSGSETPGTSESATPESGPGSEPATSGSETPGTSESATPESGPGTSTEPSEGSA PGSPAGSPTSTEEGTSESATPESGPGSEPATSGSETPGTSESATPESGPGSPAGSPTSTEEG SPAGSPTSTEEGTSTEPSEGSAPGTSESATPESGPGTSESATPESGPGTSESATPESGPGSE PATSGSETPGSEPATSGSETPGSPAGSPTSTEEGTSTEPSEGSAPGTSTEPSEGSAPGSEPA TS | 143 |
| AE720A | TSGSETPGSEPATSGSETPGSPAGSPTSTEEGTSESATPESGPGTSTEPSEGSAPGTSTEPS EGSAPGSPAGSPTSTEEGTSTEPSEGSAPGTSTEPSEGSAPGTSESATPESGPGTSTEPSEG SAPGTSESATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESATPESGPG TSTEPSEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSPAGSP TSTEEGSPAGSPTSTEEGSPAGSPTSTEEGTSESATPESGPGTSTEPSEGSAPGTSESATPE SGPGSEPATSGSETPGTSESATPESGPGSEPATSGSETPGTSESATPESGPGTSTEPSEGSA PGSPAGSPTSTEEGTSESATPESGPGSEPATSGSETPGTSESATPESGPGSPAGSPTSTEEG SPAGSPTSTEEGTSTEPSEGSAPGTSESATPESGPGTSESATPESGPGTSESATPESGPGSE PATSGSETPGSEPATSGSETPGSPAGSPTSTEEGTSTE | 144 |
| AE756A | TSGSETPGSEPATSGSETPGSPAGSPTSTEEGTSESATPESGPGTSTEPSEGSAPGTSTEPS EGSAPGSPAGSPTSTEEGTSTEPSEGSAPGTSTEPSEGSAPGTSESATPESGPGTSTEPSEG SAPGTSESATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESATPESGPG TSTEPSEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETPGTSES ATPESGPGSEPATSGSETPGTSESATPESGPGTSTEPSEGSAPGTSESATPESGPGSPAGSP TSTEEGSPAGSPTSTEEGSPAGSPTSTEEGTSESATPESGPGTSTEPSEGSAPGTSESATPE SGPGSEPATSGSETPGTSESATPESGPGSEPATSGSETPGTSESATPESGPGTSTEPSEGSA | 145 |

TABLE 4-continued

XTEN Polypeptides

| XTEN Name | Amino Acid Sequence | SEQ ID NO: |
|---|---|---|
| | PGSPAGSPTSTEEGTSESATPESGPGSEPATSGSETPGTSESATPESGPGSPAGSPTSTEEG SPAGSPTSTEEGTSTEPSEGSAPGTSESATPESGPGTSESATPESGPGTSESATPESGPGSE PATSGSETPGSEPATSGSETPGSPAGSPTSTEEGTSTEPSEGSAPGTSTEPSEGSAPGSEPA TSGSETPGTSES | |
| AE792A | EGSAPGTSESATPESGPGSEPATSGSETPGSEPATSGSETPGSPAGSPTSTEEGTSESATPE SGPGTSTEPSEGSAPGTSTEPSEGSAPGSPAGSPTSTEEGTSTEPSEGSAPGTSTEPSEGSA PGTSESATPESGPGTSTEPSEGSAPGTSESATPESGPGSEPATSGSETPGTSTEPSEGSAPG TSTEPSEGSAPGTSESATPESGPGTSESATPESGPGSPAGSPTSTEEGTSESATPESGPGSE PATSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSESAT PESGPGSEPATSGSETPGTSESATPESGPGSEPATSGSETPGTSESATPESGPGTSTEPSEG SAPGTSESATPESGPGSPAGSPTSTEEGSPAGSPTSTEEGSPAGSPTSTEEGTSESATPESG PGTSTEPSEGSAPGTSESATPESGPGSEPATSGSETPGTSESATPESGPGSEPATSGSETPG TSESATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTSTEPS EGSAPGTSTEPSEGSAPGSEPATSGSETPGTSESATPESGPGTSTEPS | 146 |
| AE828A | PESGPGTSTEPSEGSAPGSPAGSPTSTEEGTSTEPSEGSAPGTSTEPSEGSAPGTSESATPE SGPGSEPATSGSETPGSEPATSGSETPGSPAGSPTSTEEGTSESATPESGPGTSTEPSEGSA PGTSTEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSAPGTS ESATPESGPGTSESATPESGPGSPAGSPTSTEEGTSESATPESGPGSEPATSGSETPGTSES ATPESGPGTSTEPSEGSAPGTSTEPSEGSAPGTSTEPSEGSAPGTSTEPSEGSAPGTSTEPS EGSAPGTSTEPSEGSAPGSPAGSPTSTEEGTSTEPSEGSAPGTSESATPESGPGSEPATSGS ETPGTSESATPESGPGSEPATSGSETPGTSESATPESGPGTSTEPSEGSAPGTSESATPESG PGSPAGSPTSTEEGSPAGSPTSTEEGSPAGSPTSTEEGTSESATPESGPGTSTEPSEGSAPG TSESATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPGSPAG SPTSTEEGSPAGSPTSTEEGTSTEPSEGSAPGTSESATPESGPGTSESATPESGPGTSESAT PESGPGSEPATSGSETPGSEPATSGSETPGSPAGSPTSTEEGTSTEPSEGSAPGTSTEPSEG SAPGSEPATSGSETPGTSESAT | 147 |
| AG72A | GPGSSPSASTGTGPGTPGSGTASSSPGSSTPSGATGSPGSSPSASTGTGPGASPGTSSTGS PGTPGSGTASS | 148 |
| AG72B | GSSTPSGATGSPGSSTPSGATGSPGSSPSASTGTGPGSSPSASTGTGPGASPGTSSTGSPG TPGSGTASSSP | 149 |
| AG72C | SPSASTGTGPGASPGTSSTGSPGSSPSASTGTGPGTPGSGTASSSPGSSTPSGATGSPGSST PSGATGSPGA | 150 |
| AG108A | SASTGTGPGSSPSASTGTGPGTPGSGTASSSPGSSTPSGATGSPGSSPSASTGTGPGASPG TSSTGSPGTPGSGTASSSPGSSTPSGATGSPGTPGSGTASSSPGASP | 151 |
| AG108B | PGTPGSGTASSSPGSSTPSGATGSPGTPGSGTASSSPGSSTPSGATGSPGSSTPSGATGSP GSSPSASTGTGPGSSPSASTGTGPGASPGTSSTGSPGTPGSGTASSS | 152 |
| AG144A | PGSSPSASTGTGPGSSPSASTGTGPGTPGSGTASSSPGSSTPSGATGSPGSSPSASTGTGP GASPGTSSTGSPGTPGSGTASSSPGSSTPSGATGSPGTPGSGTASSSPGASPGTSSTGSPG ASPGTSSTGSPGTPGSGTASSS | 153 |
| AG144B | PSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPGSSPSA STGTGPGASPGTSSTGSPGASP | 154 |
| AG180A | TSSTGSPGSSPSASTGTGPGSSPSASTGTGPGTPGSGTASSSPGSSTPSGATGSPGSSPSAS TGTGPGASPGTSSTGSPGTPGSGTASSSPGSSTPSGATGSPGTPGSGTASSSPGASPGTSS TGSPGASPGTSSTGSPGTPGSGTASSSPGSSTPSGATGSPGASPGTSSTGSPGTPGS | 155 |
| AG216A | TGTGPGSSPSASTGTGPGTPGSGTASSSPGSSTPSGATGSPGSSPSASTGTGPGASPGTSS TGSPGTPGSGTASSSPGSSTPSGATGSPGTPGSGTASSSPGASPGTSSTGSPGASPGTSST GSPGTPGSGTASSSPGSSTPSGATGSPGASPGTSSTGSPGTPGSGTASSSPGSSTPSGATG SPGSSPSASTGTGPGSSPSASTGTGPGSSTPSG | 156 |
| AG252A | TSSTGSPGSSPSASTGTGPGSSPSASTGTGPGTPGSGTASSSPGSSTPSGATGSPGSSPSAS TGTGPGASPGTSSTGSPGTPGSGTASSSPGSSTPSGATGSPGTPGSGTASSSPGASPGTSS TGSPGASPGTSSTGSPGTPGSGTASSSPGSSTPSGATGSPGASPGTSSTGSPGTPGSGTAS SSPGSSTPSGATGSPGSSPSASTGTGPGSSPSASTGTGPGSSTPSGATGSPGSSTPSGATGS PGASPG | 157 |
| AG288A | TSSTGSPGSSPSASTGTGPGSSPSASTGTGPGTPGSGTASSSPGSSTPSGATGSPGSSPSAS TGTGPGASPGTSSTGSPGTPGSGTASSSPGSSTPSGATGSPGTPGSGTASSSPGASPGTSS | 158 |

TABLE 4-continued

XTEN Polypeptides

| XTEN Name | Amino Acid Sequence | SEQ ID NO: |
|---|---|---|
| | TGSPGASPGTSSTGSPGTPGSGTASSSPGSSTPSGATGSPGASPGTSSTGSPGTPGSGTAS SSPGSSTPSGATGSPGSSPSASTGTGPGSSPSASTGTGPGSSTPSGATGSPGSSTPSGATGS PGASPGTSSTGSPGASPGTSSTGSPGASPGTSSTGSPGTPGS | |
| AG324A | TSSTGSPGTPGSGTASSSPGASPGTSSTGSPGASPGTSSTGSPGASPGTSSTGSPGASPGTS STGSPGTPGSGTASSSPGSSTPSGATGSPGTPGSGTASSSPGSSTPSGATGSPGSGTA SSSPGSSTPSGATGSPGSSTPSGATGSPGSSPSASTGTGPGSSPSASTGTGPGASPGTSSTG SPGTPGSGTASSSPGSSTPSGATGSPGSSPSASTGTGPGSSPSASTGTGPGASPGTSSTGSP GASPGTSSTGSPGSSTPSGATGSPGSSPSASTGTGPGASPGTSSTGSPGSSPSASTGTGPG TPGSGTASSSPGSSTP | 159 |
| AG360A | TSSTGSPGASPGTSSTGSPGTPGSGTASSSPGASPGTSSTGSPGASPGTSSTGSPGASPGTS STGSPGASPGTSSTGSPGTPGSGTASSSPGSSTPSGATGSPGTPGSGTASSSPGSSTPSGAT GSPGTPGSGTASSSPGSSTPSGATGSPGSSTPSGATGSPGSSPSASTGTGPGSSPSASTGT GPGASPGTSSTGSPGTPGSGTASSSPGSSTPSGATGSPGSSPSASTGTGPGSSPSASTGT PGASPGTSSTGSPGASPGTSSTGSPGSSTPSGATGSPGSSPSASTGTGPGASPGTSSTGSP GSSPSASTGTGPGTPGSGTASSSPGSSTPSGATGSPGSSTPSGATGSPGASPG | 160 |
| AG396A | GATGSPGSSTPSGATGSPGSSPSASTGTGPGASPGTSSTGSPGASPGTSSTGSPGTPGSGT ASSSPGASPGTSSTGSPGASPGTSSTGSPGASPGTSSTGSPGASPGTSSTGSPGTPGSGTA SSSPGSSTPSGATGSPGTPGSGTASSSPGSSTPSGATGSPGTPGSGTASSSPGSSTPSGATG SPGSSTPSGATGSPGSSPSASTGTGPGSSPSASTGTGPGASPGTSSTGSPGTPGSGTASSSP GSSTPSGATGSPGSSPSASTGTGPGSSPSASTGTGPGASPGTSSTGSPGASPGTSSTGSPG SSTPSGATGSPGSSPSASTGTGPGASPGTSSTGSPGSSPSASTGTGPGTPGSGTASSSPGSS TPSGATGSPGSSTPSGATGSPGASPGT | 161 |
| AG432A | GATGSPGSSTPSGATGSPGASPGTSSTGSPGTPGSGTASSSPGSSTPSGATGSPGSSTPSG ATGSPGSSTPSGATGSPGSSPSASTGTGPGASPGTSSTGSPGASPGTSSTGSPGTPGSGTA SSSPGASPGTSSTGSPGASPGTSSTGSPGASPGTSSTGSPGASPGTSSTGSPGTPGSGTASS SPGSSTPSGATGSPGTPGSGTASSSPGSSTPSGATGSPGTPGSGTASSSPGSSTPSGATGSP GSSTPSGATGSPGSSPSASTGTGPGSSPSASTGTGPGASPGTSSTGSPGTPGSGTASSSPG SSTPSGATGSPGSSPSASTGTGPGSSPSASTGTGPGASPGTSSTGSPGASPGTSSTGSPGSS TPSGATGSPGSSPSASTGTGPGASPGTSSTGSPGSSPSASTGTGPGTPGSGTASSSPGSSTP S | 162 |
| AG468A | TSSTGSPGSSPSASTGTGPGTPGSGTASSSPGASPGTSSTGSPGASPGTSSTGSPGASPGTS STGSPGSSTPSGATGSPGSSTPSGATGSPGASPGTSSTGSPGTPGSGTASSSPGSSTPSGAT GSPGSSTPSGATGSPGSSTPSGATGSPGSSPSASTGTGPGASPGTSSTGSPGASPGTSSTG SPGTPGSGTASSSPGASPGTSSTGSPGASPGTSSTGSPGASPGTSSTGSPGASPGTSSTGSP GTPGSGTASSSPGSSTPSGATGSPGTPGSGTASSSPGSSTPSGATGSPGTPGSGTASSSPG SSTPSGATGSPGSSTPSGATGSPGSSPSASTGTGPGSSPSASTGTGPGASPGTSSTGSPGTP GSGTASSSPGSSTPSGATGSPGSSPSASTGTGPGSSPSASTGTGPGASPGTSSTGSPGASP GTSSTGSPGSSTPSGATGSPGSSPSASTGTGPGASPG | 163 |
| AG504A | TSSTGSPGSSPSASTGTGPGTPGSGTASSSPGASPGTSSTGSPGASPGTSSTGSPGASPGTS STGSPGSSTPSGATGSPGSSTPSGATGSPGASPGTSSTGSPGTPGSGTASSSPGSSTPSGAT GSPGSSTPSGATGSPGSSTPSGATGSPGSSPSASTGTGPGASPGTSSTGSPGASPGTSSTG SPGTPGSGTASSSPGASPGTSSTGSPGASPGTSSTGSPGASPGTSSTGSPGASPGTSSTGSP GTPGSGTASSSPGSSTPSGATGSPGTPGSGTASSSPGSSTPSGATGSPGTPGSGTASSSPG SSTPSGATGSPGSSTPSGATGSPGSSPSASTGTGPGSSPSASTGTGPGASPGTSSTGSPGTP GSGTASSSPGSSTPSGATGSPGSSPSASTGTGPGSSPSASTGTGPGASPGTSSTGSPGASP GTSSTGSPGSSTPSGATGSPGSSPSASTGTGPGASPGTSSTGSPGSSPSASTGTGPGTPGS GTASSSPGSSTP | 164 |
| AG540A | TSSTGSPGASPGTSSTGSPGSSPSASTGTGPGTPGSGTASSSPGASPGTSSTGSPGASPGTS STGSPGASPGTSSTGSPGSSTPSGATGSPGSSTPSGATGSPGASPGTSSTGSPGTPGSGTA SSSPGSSTPSGATGSPGSSTPSGATGSPGSSTPSGATGSPGSSPSASTGTGPGASPGTSSTG SPGASPGTSSTGSPGTPGSGTASSSPGASPGTSSTGSPGASPGTSSTGSPGASPGTSSTGSP GASPGTSSTGSPGTPGSGTASSSPGSSTPSGATGSPGTPGSGTASSSPGSSTPSGATGSPG TPGSGTASSSPGSSTPSGATGSPGSSTPSGATGSPGSSPSASTGTGPGSSPSASTGTGPGA SPGTSSTGSPGTPGSGTASSSPGSSTPSGATGSPGSSPSASTGTGPGSSPSASTGTGPGASP GTSSTGSPGASPGTSSTGSPGSSTPSGATGSPGSSPSASTGTGPGASPGTSSTGSPGSSPSA STGTGPGTPGSGTASSSPGSSTPSGATGSPGSSTPSGATGSPGASPG | 165 |
| AG576A | TSSTGSPGTPGSGTASSSPGASPGTSSTGSPGASPGTSSTGSPGASPGTSSTGSPGSSPSAS TGTGPGTPGSGTASSSPGASPGTSSTGSPGASPGTSSTGSPGASPGTSSTGSPGSSTPSGA TGSPGSSTPSGATGSPGASPGTSSTGSPGTPGSGTASSSPGSSTPSGATGSPGSSTPSGAT GSPGSSTPSGATGSPGSSPSASTGTGPGASPGTSSTGSPGASPGTSSTGSPGTPGSGTASS SPGASPGTSSTGSPGASPGTSSTGSPGASPGTSSTGSPGASPGTSSTGSPGTPGSGTASSSP GSSTPSGATGSPGTPGSGTASSSPGSSTPSGATGSPGTPGSGTASSSPGSSTPSGATGSPG SSTPSGATGSPGSSPSASTGTGPGSSPSASTGTGPGASPGTSSTGSPGTPGSGTASSSPGSS TPSGATGSPGSSPSASTGTGPGSSPSASTGTGPGASPGTSSTGSPGASPGTSSTGSPGSSTP SGATGSPGSSPSASTGTGPGASPGTSSTGSPGSSPSASTGTGPGTPGSGTASSSPGSSTPS GATGSPGSSTPSGATGSPGASPG | 166 |

TABLE 4-continued

XTEN Polypeptides

| XTEN Name | Amino Acid Sequence | SEQ ID NO: |
|---|---|---|
| AG612A | STGSPGTPGSGTASSSPGSSTPSGATGSPGASPGTSSTGSPGTPGSGTASSSPGSSTPSGAT GSPGSSPSASTGTGPGSSPSASTGTGPGSSTPSGATGSPGSSTPSGATGSPGASPGTSSTG SPGASPGTSSTGSPGASPGTSSTGSPGTPGSGTASSSPGASPGTSSTGSPGASPGTSSTGSP GASPGTSSTGSPGSSPSASTGTGPGTPGSGTASSSPGASPGTSSTGSPGASPGTSSTGSPG ASPGTSSTGSPGSSTPSGATGSPGSSTPSGATGSPGASPGTSSTGSPGTPGSGTASSSPGSS TPSGATGSPGSSTPSGATGSPGSSTPSGATGSPGSSPSASTGTGPGASPGTSSTGSPGASP GTSSTGSPGTPGSGTASSSPGASPGTSSTGSPGASPGTSSTGSPGASPGTSSTGSPGASPG TSSTGSPGTPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTGPGASPGTSS TGSPGTPGSGTASSSPGSSTPSGATGSPGSSPSASTGTGPGSSPSASTGTGPGASPGTS | 167 |
| AG648A | GTASSSPGSSTPSGATGSPGSSPSASTGTGPGSSPSASTGTGPGSSTPSGATGSPGSSTPSG ATGSPGASPGTSSTGSPGASPGTSSTGSPGASPGTSSTGSPGTPGSGTASSSPGASPGTSS TGSPGASPGTSSTGSPGASPGTSSTGSPGSSPSASTGTGPGTPGSGTASSSPGASPGTSST GSPGASPGTSSTGSPGASPGTSSTGSPGSSTPSGATGSPGSSTPSGATGSPGASPGTSSTG SPGTPGSGTASSSPGSSTPSGATGSPGSSTPSGATGSPGSSTPSGATGSPGSSPSASTGTGP GASPGTSSTGSPGASPGTSSTGSPGTPGSGTASSSPGASPGTSSTGSPGASPGTSSTGSPG ASPGTSSTGSPGASPGTSSTGSPGTPGSGTASSSPGSSTPSGATGSPGTPGSGTASSSPGSS TPSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPGSSPSA STGTGPGASPGTSSTGSPGASPGTSSTGSPGSSTPSGATGSPGSSPSASTGTGPGASPGTS STGSPGSSPSASTGTGPGTPGSGTASSSPGSSTP | 168 |
| AG684A | TSSTGSPGTPGSGTASSSPGSSTPSGATGSPGSSPSASTGTGPGSSPSASTGTGPGSSTPSG ATGSPGSSTPSGATGSPGASPGTSSTGSPGASPGTSSTGSPGASPGTSSTGSPGTPGSGTA SSSPGASPGTSSTGSPGASPGTSSTGSPGASPGTSSTGSPGSSPSASTGTGPGTPGSGTASS SPGASPGTSSTGSPGASPGTSSTGSPGASPGTSSTGSPGSSTPSGATGSPGSSTPSGATGSP GASPGTSSTGSPGTPGSGTASSSPGSSTPSGATGSPGSSTPSGATGSPGSSTPSGATGSPG SSPSASTGTGPGASPGTSSTGSPGASPGTSSTGSPGTPGSGTASSSPGASPGTSSTGSPGA SPGTSSTGSPGASPGTSSTGSPGASPGTSSTGSPGTPGSGTASSSPGSSTPSGATGSPGTPG SGTASSSPGSSTPSGATGSPGTPGSGTASSSPGSSTPSGATGSPGSSPSA STGTGPGSSPSASTGTGPGASPGTSSTGSPGTPGSGTASSSPGSSTPSGATGSPGSSPSAST GTGPGSSPSASTGTGPGASPGTSSTGSPGASPGTSSTGSPGSSTPSGATGSPGSSPSASTG TGPGASPGTSSTGSPGSSPSASTGTGPGTPGSGTASSSPGSSTPSGATGSPGSSTPSGATG SPGASPG | 169 |
| AG720A | TSSTGSPGTPGSGTASSSPGSSTPSGATGSPGASPGTSSTGSPGTPGSGTASSSPGSSTPSG ATGSPGSSPSASTGTGPGSSPSASTGTGPGSSTPSGATGSPGSSTPSGATGSPGASPGTSS TGSPGASPGTSSTGSPGASPGTSSTGSPGTPGSGTASSSPGASPGTSSTGSPGASPGTSST GSPGASPGTSSTGSPGSSPSASTGTGPGTPGSGTASSSPGASPGTSSTGSPGASPGTSSTG SPGASPGTSSTGSPGSSTPSGATGSPGSSTPSGATGSPGASPGTSSTGSPGTPGSGTASSSP GSSTPSGATGSPGSSTPSGATGSPGSSTPSGATGSPGSSPSASTGTGPGASPGTSSTGSPG ASPGTSSTGSPGTPGSGTASSSPGASPGTSSTGSPGASPGTSSTGSPGA SPGTSSTGSPGTPGSGTASSSPGSSTPSGATGSPGTPGSGTASSSPGSSTPSGATGSPGTPG SGTASSSPGSSTPSGATGSPGSSTPSGATGSPGSSPSASTGTGPGSSPSASTGTGPGASPG TSSTGSPGTPGSGTASSSPGSSTPSGATGSPGSSPSASTGTGPGSSPSASTGTGPGASPGTS STGSPGASPGTSSTGSPGSSTPSGATGSPGSSPSASTGTGPGASPGTSSTGSPGSSPSASTG TGPGTPGSGTASSSPGSSTPSGATGSPGSSTPSGATGSPGASPG | 170 |
| AG756A | TSSTGSPGSSPSASTGTGPGSSPSASTGTGPGTPGSGTASSSPGSSTPSGATGSPGSSPSAS TGTGPGASPGTSSTGSPGTPGSGTASSSPGSSTPSGATGSPGTPGSGTASSSPGSSTPGTSS TGSPGASPGTSSTGSPGTPGSGTASSSPGSSTPSGATGSPGASPGTSSTGSPGTPGSGTAS SSPGSSTPSGATGSPGSSPSASTGTGPGSSPSASTGTGPGSSTPSGATGSPGSSTPSGATGS PGASPGTSSTGSPGASPGTSSTGSPGASPGTSSTGSPGTPGSGTASSSPGASPGTSSTGSP GASPGTSSTGSPGASPGTSSTGSPGSSPSASTGTGPGTPGSGTASSSPGASPGTSSTGSPG ASPGTSSTGSPGASPGTSSTGSPGSSTPSGATGSPGSSTPSGATGSPGASPGTSSTGSPGTP GSGTASSSPGSSTPSGATGSPGSSTPSGATGSPGSSTPSGATGSPGSSPSASTGTGPGASP GTSSTGSPGASPGTSSTGSPGTPGSGTASSSPGASPGTSSTGSPGASPG TSSTGSPGASPGTSSTGSPGTPGSGTASSSPGSSTPSGATGSPGTPGSGTASSSPGSSTPSG ATGSPGTPGSGTASSSPGSSTPSGATGSPGSSTPSGATGSPGSSPSASTGTGPGSSPSAST GTGPGASPGTSSTGSPGTPGSGTASSSPGSSTPSGATGSPGSSPSASTGTGPGSSPSASTG TGPGASPGTSSTGSPGASPG | 171 |
| AG792A | TSSTGSPGSSPSASTGTGPGSSPSASTGTGPGTPGSGTASSSPGSSTPSGATGSPGSSPSAS TGTGPGASPGTSSTGSPGTPGSGTASSSPGSSTPSGATGSPGTPGSGTASSSPGASPGTSS TGSPGASPGTSSTGSPGTPGSGTASSSPGSSTPSGATGSPGASPGTSSTGSPGTPGSGTAS SSPGSSTPSGATGSPGSSPSASTGTGPGSSPSASTGTGPGSSTPSGATGSPGSSTPSGATGS PGASPGTSSTGSPGASPGTSSTGSPGASPGTSSTGSPGTPGSGTASSSP GASPGTSSTGSPGASPGTSSTGSPGSSPSASTGTGPGTPGSGTASSSPGASPGTSSTGSPG ASPGTSSTGSPGASPGTSSTGSPGSSTPSGATGSPGSSTPSGATGSPGASPGTSSTGSPGTP GSGTASSSPGSSTPSGATGSPGSSTPSGATGSPGSSTPSGATGSPGSSPSASTGTGPGASP GTSSTGSPGASPGTSSTGSPGTPGSGTASSSPGASPGTSSTGSPGASPGTSSTGSPGASPG TSSTGSPGASPGTSSTGSPGTPGSGTASSSPGSSTPSGATGSPGTPGSGTASSSPGSSTPSG | 172 |

TABLE 4-continued

XTEN Polypeptides

| XTEN Name | Amino Acid Sequence | SEQ ID NO: |
|---|---|---|
| | ATGSPGTPGSGTASSSPGSSTPSGATGSPGSSTPSGATGSPGSSPSASTGTGPGSSPSAST GTGPGASPGTSSTGSPGTPGSGTASSSPGSSTPSGATGSPGSSPSASTGTGPGSSPSASTG TGPGASPGTSSTGSPGASPGTSSTGSPGSSTPSGATGSPGSSPSASTGTGPGASPG | |
| AG828A | TSSTGSPGSSPSASTGTGPGSSPSASTGTGPGTPGSGTASSSPGSSTPSGATGSPGSSPSAS TGTGPGASPGTSSTGSPGTPGSGTASSSPGSSTPSGATGSPGTPGSGTASSSPGASPGTSS TGSPGASPGTSSTGSPGTPGSGTASSSPGSSTPSGATGSPGASPGTSSTGSPGTPGSGTAS SSPGSSTPSGATGSPGSSPSASTGTGPGSSPSASTGTGPGSSTPSGATGSPGSSTPSGATGS PGASPGTSSTGSPGASPGTSSTGSPGASPGTSSTGSPGTPGSGTASSSPGASPGTSSTGSP GASPGTSSTGSPGASPGTSSTGSPGSSPSASTGTGPGTPGSGTASSSPGASPGTSSTGSPG ASPGTSSTGSPGASPGTSSTGSPGSSTPSGATGSPGSSTPSGATGSPGASPGTSSTGSPGTP GSGTASSSPGSSTPSGATGSPGSSTPSGATGSPGSSTPSGATGSPGSSPSASTGTGPGASP GTSSTGSPGASPGTSSTGSPGTPGSGTASSSPGASPGTSSTGSPGASPGTSSTGSPGASPG TSSTGSPGASPGTSSTGSPGTPGSGTASSSPGSSTPSGATGSPGTPGSGTASSSPGSSTPSG ATGSPGTPGSGTASSSPGSSTPSGATGSPGSSTPSGATGSPGSSPSASTGTGPGSSPSAST GTGPGASPGTSSTGSPGTPGSGTASSSPGSSTPSGATGSPGSSPSASTGTGPGSSPSASTG TGPGASPGTSSTGSPGASPGTSSTGSPGSSTPSGATGSPGSSPSASTGTGPGASPGTSSTG SPGSSPSASTGTGPGTPGSGTASSSPGSSTP | 173 |
| AG288_DE | GTPGSGTASSSPGSSTPSGATGSPGSSTPSGATGSPGSSTPSGATGSPGSSPSASTGTGPG ASPGTSSTGSPGASPGTSSTGSPGTPGSGTASSSPGASPGTSSTGSPGASPGTSSTGSPGA SPGTSSTGSPGASPGTSSTGSPGTPGSGTASSSPGSSTPSGATGSPGTPGSGTASSSPGSST PSGATGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSP | 1699 |

In other embodiments, the CFXTEN composition comprises one or more non-repetitive XTEN sequences of lengths ranging from about 36 to about 3000 amino acid residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 13-17, either as a family sequence, or where motifs are selected from two or more families of motifs.

In those embodiments wherein the XTEN component of the CFXTEN fusion protein has less than 100% of its amino acids consisting of 4, 5, or 6 types of amino acid selected from glycine (G), alanine (A), serine (S), threonine (T), glutamate (E) and proline (P), or less than 100% of the sequence consisting of the sequence motifs from Table 3 or the XTEN sequences of Tables 4, and 13-17, the other amino acid residues of the XTEN are selected from any of the other 14 natural L-amino acids, but are preferentially selected from hydrophilic amino acids such that the XTEN sequence contains at least about 90%, 91%, 92%, 93%, 94%, 95%, 96%, 97%, 98%, or at least about 99% hydrophilic amino acids. The XTEN amino acids that are not glycine (G), alanine (A), serine (S), threonine (T), glutamate (E) and proline (P) are either interspersed throughout the XTEN sequence, are located within or between the sequence motifs, or are concentrated in one or more short stretches of the XTEN sequence, e.g., to create a linker between the XTEN and the FVIII components. In such cases where the XTEN component of the CFXTEN comprises amino acids other than glycine (G), alanine (A), serine (S), threonine (T), glutamate (E) and proline (P), it is preferred that less than about 2% or less than about 1% of the amino acids be hydrophobic residues such that the resulting sequences generally lack secondary structure, e.g., not having more than 2% alpha helices or 2% beta-sheets, as determined by the methods disclosed herein. Hydrophobic residues that are less favored in construction of XTEN include tryptophan, phenylalanine, tyrosine, leucine, isoleucine, valine, and methionine. Additionally, one can design the XTEN sequences to contain less than 5% or less than 4% or less than 3% or less than 2% or less than 1% or none of the following amino acids: cysteine (to avoid disulfide formation and oxidation), methionine (to avoid oxidation), asparagine and glutamine (to avoid desamidation). Thus, in some embodiments, the XTEN component of the CFXTEN fusion protein comprising other amino acids in addition to glycine (G), alanine (A), serine (S), threonine (T), glutamate (E) and proline (P) have a sequence with less than 5% of the residues contributing to alpha-helices and beta-sheets as measured by the Chou-Fasman algorithm and have at least 90%, or at least about 95% or more random coil formation as measured by the GOR algorithm.

3. Length of Sequence

In another aspect, the invention provides XTEN of varying lengths for incorporation into CFXTEN compositions wherein the length of the XTEN sequence(s) are chosen based on the property or function to be achieved in the fusion protein. Depending on the intended property or function, the CFXTEN compositions comprise short or intermediate length XTEN located internal to the FVIII sequence or between FVIII domains and/or longer XTEN sequences that can serve as carriers, located in the fusion proteins as described herein. While not intended to be limiting, the XTEN or fragments of XTEN include short segments of about 6 to about 99 amino acid residues, intermediate lengths of about 100 to about 399 amino acid residues, and longer lengths of about 400 to about 1000 and up to about 3000 amino acid residues. Thus, the XTEN for incorporation into the subject CFXTEN encompass XTEN or fragments of XTEN with lengths of about 6, or about 12, or about 36, or about 40, or about 42, or about 72 or about 96, or about 144, or about 288, or about 400, or about 500, or about 576, or about 600, or about 700, or about 800, or about 864, or about 900, or about 1000, or about 1500, or about 2000, or about 2500, or up to about 3000 amino acid residues in length. Alternatively, the XTEN sequences can be about 6 to about 50, about 50 to about 100, about 100 to 150, about 150 to 250, about 250 to 400, about 400 to about 500, about 500 to about 900, about 900 to 1500, about 1500 to 2000, or about 2000 to about 3000 amino acid residues in length. The precise length of an XTEN incorporated into the subject CFXTEN can vary without adversely affecting the activity of a CFXTEN composition. In one embodiment, one or more of the XTEN used in the CFXTEN disclosed herein has 36 amino acids, 42 amino acids, 144 amino acids, 288 amino acids, 576 amino acids, or 864 amino acids in length and may be selected from one of the XTEN family sequences; i.e., AD, AE, AF, AG, AM, AQ, BC or BD. In another embodiment, two or more of the XTEN used in the CFXTEN disclosed herein has 36 amino acids, 42 amino acids, 144 amino acids, 288 amino acids, 576 amino acids, or 864 amino acids in length and may be selected from two of the XTEN family sequences; i.e., AD, AE, AF, AG, AM, AQ, BC or BD, with combinations of AE and AG family sequences preferred. In some embodiments, CFXTEN comprising one or more of the XTEN used herein contain XTEN selected from any one of the sequences in Table 4, which may be linked to the FVIII component directly or via spacer sequences disclosed herein.

In particular CFXTEN configuration designs, where the XTEN serve as a flexible linker, or are inserted in external loops or unordered regions of the FVIII sequence to increase the bulk, flexibility, or hydrophilicity of the region, or are designed to interfere with clearance receptors for FVIII to enhance pharmacokinetic properties, or to interfere with binding of FVIII inhibitors or other anti-FVIII antibodies, or where a short or intermediate length of XTEN is used to facilitate tissue penetration or to vary the strength of interactions of the CFXTEN fusion protein with its target, or where it is desirable to distribute the cumulative length of XTEN in segments of short or intermediate length at multiple locations within the FVIII sequence, the invention contemplates CFXTEN compositions with one, two, three, four, five or more short or intermediate XTEN sequences inserted between or within one or more FVIII domains or within external loops, or at other sites in the FVIII sequence such as, but not limited to, locations at or proximal to the insertion sites identified in Table 5, Table 6, Table 7, Table 8, and Table 9 or as illustrated in FIGS. 8-9. In one embodiment of the foregoing, the CFXTEN fusion protein contains multiple XTEN segments, e.g., at least two, or at least three, or at least four, or at least five or more XTEN segments in which the XTEN segments can be identical or they can be different and wherein the CFXTEN retains at least 10%, 20%, 30%, 40%, 50%, 60%, 70% or more of the procoagulant activity of native FVIII when assayed by one of the assays disclosed herein. In other particular CFXTEN configuration designs, where the XTEN serves as a carrier to increase the bulk of the fusion protein, or to vary the strength of interactions of the CFXTEN fusion protein with its target, or to enhance the pharmacokinetic properties of the fusion protein, the invention contemplates CFXTEN compositions with one or more intermediate or longer length XTEN sequences inserted at the C-terminus, within the B domain (or the residual of the BDD sequence) between or within one or more FVIII domains, within external loops, or at other sites in the FVIII sequence such as, but not limited to, insertion sites identified in Table 5, Table 6, Table 7, Table 8, and Table 9 or as illustrated in FIGS. 8-9. However, it is believed that the incorporation of multiple XTEN of short to intermediate lengths into CFXTEN compositions confers enhanced properties on the fusion proteins compared to CFXTEN fusion proteins with the same number of amino acids in fewer but longer length XTEN, yet still results in compositions with procoagulant activity and extended half-life; the rationale of which is detailed herein regarding the derived radii of multiple XTEN.

In the embodiments wherein the CFXTEN fusion proteins comprise multiple XTEN sequences, the cumulative length of the total residues in the XTEN sequences is greater than about 100 to about 3000, or about 200 to about 2000, or about 400 to about 1000 amino acid residues and the XTEN can be identical or they can be different in sequence, net charge, or in length. In one embodiment of CFXTEN comprising multiple XTEN, the individual XTEN sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a motif or an XTEN selected from Tables 3, 4, and 13-17 or a fragment thereof, when optimally aligned with a sequence of comparable length.

As described more fully below, methods are disclosed in which the CFXTEN are designed by selecting the length of the XTEN and its site of incorporation within the CFXTEN to confer a target half-life, retention of procoagulant activity, reduced binding to FVIII inhibitors or an enhanced physicochemical property (e.g., stability or solubility) of a CFXTEN fusion protein, encoding constructs are created and expressed and the recombinant CFXTEN fusion proteins are isolated and recovered. In general, XTEN cumulative lengths longer that about 400 residues incorporated into the CFXTEN compositions result in longer half-life compared to shorter cumulative lengths, e.g., shorter than about 280 residues. In one embodiment, CFXTEN fusion proteins designs are contemplated that comprise at least a single XTEN as a carrier, with a long sequence length of at least about 400, or at least about 600, or at least about 800, or at least about 900, or at least about 1000 or more amino acids. In another embodiment, multiple XTEN are incorporated into the fusion protein to achieve cumulative lengths of at least about 400, or at least about 600, or at least about 800, or at least about 900, or at least about 1000 or more amino acids, wherein the XTEN can be identical or they can be different in sequence or length. As used herein, "cumulative length" is intended to encompass the total length, in amino acid residues, when more than one XTEN is incorporated into the CFXTEN fusion protein. Both of the foregoing embodiments are designed to confer increased bioavailability and/or increased terminal half-life after administration to a subject compared to CFXTEN comprising shorter cumulative XTEN lengths, yet still result in a procoagulant activity and hemostasis effect. When administered subcutaneously or intramuscularly, the $C_{max}$ is reduced but the area under the curve (AUC) is increased in comparison to a comparable dose of a CFXTEN with shorter cumulative length XTEN or FVIII not linked to XTEN, thereby contributing to the ability to maintain effective levels of the CFXTEN composition for a longer period of time and permitting increased periods of 2, 4, 7, 10, 14 or 21 days between dosing, as described more fully below. Thus, the XTEN confers the property of a depot to the administered CFXTEN, in addition to the other physicochemical properties described herein.

When XTEN are used as a carrier, the invention takes advantage of the discovery that increasing the length of the non-repetitive, unstructured polypeptides enhances the unstructured nature of the XTENs and correspondingly enhances the physical/chemical and pharmacokinetic properties of fusion proteins comprising the XTEN carrier. As described more fully in the Examples, proportional increases in the length of the XTEN, even if created by a repeated order of single family sequence motifs (e.g., the four AE motifs of Table 3), result in a sequence with a higher percentage (e.g., 90% or more) of random coil formation, as determined by GOR algorithm, or reduced content of alpha-helices or beta-sheets (e.g., less than 2%), as determined by Chou-Fasman algorithm, compared to shorter XTEN lengths. In addition, increasing the length of the unstructured polypeptide fusion partner, as described in the Examples, results in a fusion protein with a disproportionate increase in terminal half-life (e.g., as much as 50, 100, 200 or more hours) compared to fusion proteins with unstructured polypeptide partners with shorter sequence lengths. The enhanced pharmacokinetic properties of the CFXTEN in comparison to FVIII not linked to XTEN are described more fully, below.

In another aspect, the invention provides methods to create XTEN of short or intermediate lengths from longer "donor" XTEN sequences, wherein the longer donor XTEN sequence is truncated at the N-terminus, or the C-terminus, or a fragment is created from the interior of a donor sequence, thereby resulting in a short or intermediate length XTEN. In non-limiting examples, as schematically depicted in FIG. 16A-C, an AG sequence of 864 amino acid residues can be truncated to yield an AG sequence with 144 residues, an AG sequence with 288 residues, an AG sequence with 576 residues, or other intermediate lengths, while the AE sequence of 864 residues (as depicted in FIG. 16D, E) can be truncated to yield multiple AE sequences of 144 residues, an AE sequence with 288 or 576 residues or other shorter or intermediate lengths. It is specifically contemplated that such an approach can be utilized with any of the XTEN embodiments described herein or with any of the sequences listed in Tables 4 or 13-17 to result in XTEN of a desired length. In preferred embodiments, the CFXTEN comprising multiple XTEN have XTEN exhibiting at least about 80%, or at least about 90%, or at least about 91%, or at least about 92%, or at least about 93%, or at least about 94%, or at least about 95%, or at least about 96%, or at least about 97%, or at least about 98%, or at least about 99%, or 100% sequence identity to sequences selected from AE42_1, AE42_2, AE42_3, AG42_1, AG42_2, AG42_3, AG42_4, AE1441_1A, AE144_2A, AE144_2B, AE144_3A, AE144_3B, AE144_4A, AE144_4B, AE144_5A, AE144_6B, AG144_1, AG144_2, AG144_A, AG144_B, AG144_C, AG144_F, AG144_3, AG144_4, AE288_1, AE288_2, AG288_1, AG288_2, and AG288 DE.

4. Net Charge

In other embodiments, the unstructured characteristic of an XTEN polypeptide can be enhanced by incorporation of amino acid residues with a net charge and/or reduction of the overall percentage (e.g. less than 5%, or 4%, or 3%, or 2%, or 1%) of hydrophobic amino acids in the XTEN sequence. The overall net charge and net charge density is controlled by modifying the content of charged amino acids in the XTEN sequences, either positive or negative, with the net charge typically represented as the percentage of amino acids in the polypeptide contributing to a charged state beyond those residues that are cancelled by a residue with an opposite charge. In some embodiments, the net charge density of the XTEN of the compositions may be above +0.1 or below −0.1 charges/residue. By "net charge density" of a protein or peptide herein is meant the net charge divided by the total number of amino acids in the protein or propeptide.

In other embodiments, the net charge of an XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In preferred embodiments, the XTEN will have an isoelectric point between 1.5 and 4.5 and carry a net negative charge under physiologic conditions.

Since most tissues and surfaces in a human or animal have a net negative charge, in some embodiments the XTEN sequences are designed to have a net negative charge to minimize non-specific interactions between the XTEN containing compositions and various surfaces such as blood vessels, healthy tissues, or various receptors. Not to be bound by a particular theory, an XTEN can adopt open conformations due to electrostatic repulsion between individual amino acids of the XTEN polypeptide that individually carry a net negative charge and that are distributed across the sequence of the XTEN polypeptide. In some embodiments, the XTEN sequence is designed with at least 90% or 95% of the charged residues separated by other residues such as serine, alanine, threonine, proline or glycine, which leads to a more uniform distribution of charge, better expression or purification behavior. Such a distribution of net negative charge in the extended sequence lengths of XTEN can lead to an unstructured conformation that, in turn, can result in an effective increase in hydrodynamic radius. In preferred embodiments, the negative charge of the subject XTEN is conferred by incorporation of glutamic acid residues. Generally, the glutamic residues are spaced uniformly across the XTEN sequence. In some cases, the XTEN can contain about 10-80, or about 15-60, or about 20-50 glutamic residues per 20 kDa of XTEN that can result in an XTEN with charged residues that would have very similar pKa, which can increase the charge homogeneity of the product and sharpen its isoelectric point, enhance the physicochemical properties of the resulting CFXTEN fusion protein for, and hence, simplifying purification procedures. For example, where an XTEN with a negative charge is desired, the XTEN can be selected solely from an AE family sequence, which has approximately a 17% net charge due to incorporated glutamic acid, or can include varying proportions of glutamic acid-containing motifs of Table 3 to provide the desired degree of net charge. Non-limiting examples of AE XTEN include, but are not limited to the 36, 42, 144, 288, 576, 624, 864, and 912 AE family sequences of Tables 4 and 14 or fragments thereof. In one embodiment, an XTEN sequence of Tables 4, or 13-17 can be modified to include additional glutamic acid residues to achieve the desired net negative charge. Accordingly, in one embodiment the invention provides XTEN in which the XTEN sequences contain about 1%, 2%, 4%, 8%, 10%, 15%, 17%, 20%, 25%, or even about 30% glutamic acid. In one embodiment, the invention contemplates incorporation of up to 5% aspartic acid residues into XTEN in addition to glutamic acid in order to achieve a net negative charge.

In other embodiments, where no net charge is desired, the XTEN can be selected from, for example, AG XTEN components, such as the AG motifs of Table 3, or those AM motifs of Table 3 that have no net charge. Non-limiting examples of AG XTEN include, but are not limited to 36, 42, 144, 288, 576, and 864 AG family sequences of Tables 4 and 16, or fragments thereof. In another embodiment, the XTEN can comprise varying proportions of AE and AG motifs (in order to have a net charge that is deemed optimal for a given use or to maintain a given physicochemical property.

Not to be bound by a particular theory, the XTEN of the CFXTEN compositions with the higher net charge are expected to have less non-specific interactions with various negatively-charged surfaces such as blood vessels, tissues, or various receptors, which would further contribute to reduced active clearance. Conversely, it is believed that the XTEN of the CFXTEN compositions with a low (or no) net charge would have a higher degree of interaction with surfaces that can potentiate the activity of the associated coagulation factor, given the known contribution of cell (e.g., platelets) and vascular surfaces to the coagulation process and the intensity of activation of coagulation factors (Zhou, R., et al., Biomaterials (2005) 26(16):2965-2973; London, F., et al. Biochemistry (2000) 39(32):9850-9858).

The XTEN of the compositions of the present invention generally have no or a low content of positively charged amino acids. In some embodiments, the XTEN may have less than about 10% amino acid residues with a positive charge, or less than about 7%, or less than about 5%, or less than about 2%, or less than about 1% amino acid residues with a positive charge. However, the invention contemplates constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN of the subject CFXTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins can be constructed that comprise XTEN, a FVIII coagulation factor, plus a chemotherapeutic agent or other coagulation factor or cofactor useful in the treatment of coagulopathy conditions, wherein the maximum number of molecules of the agent incorporated into the XTEN component is determined by the numbers of lysines or other amino acids with reactive side chains (e.g., cysteine) incorporated into the XTEN.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a CFXTEN fusion protein is typically less than 5%, or less than 2%, and most preferably less than 1%. In another embodiment, the XTEN of the subject CFXTEN compositions will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 5% of the total XTEN sequence.

5. Low Immunogenicity

In another aspect, the XTEN sequences provided herein have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or the activation of a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity is achieved by designing XTEN sequences that resist antigen processing in antigen presenting cells, and/or choosing sequences that do not bind MHC receptors well. The invention provides CFXTEN fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity can attribute to, at least in part, a result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and also reduce the immunogenicity of the FVIII fusion partner in the CFXTEN compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods*, 281: 95-108). Of particular interest are peptide sequences that can be oligomerized without generating T cell epitopes or non-human sequences. This is achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In some embodiments, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 46. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) Nature Biotechnology 17:555). The score ranges over at least 20 logs, from about 10 to about −10 (corresponding to binding constraints of $10\,e^{10}\,K_d$ to $10\,e^{-10}\,K_d$), and can be reduced by avoiding hydrophobic amino acids that serve as anchor residues during peptide display on MHC, such as M, I, L, V, F. In some embodiments, an XTEN component incorporated into a CFXTEN does not have a predicted T-cell epitope at a TEPITOPE threshold score of about −5, or −6, or −7, or −8, or −9, or at a TEPITOPE score of −10. As used herein, a score of "−9" is a more stringent TEPITOPE threshold than a score of −5.

In another embodiment, the inventive XTEN sequences, including those incorporated into the subject CFXTEN fusion proteins, are rendered substantially non-immunogenic by the restriction of known proteolytic sites from the sequence of the XTEN, reducing the processing of XTEN into small peptides that can bind to MHC II receptors. In another embodiment, the XTEN sequence is rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN render the XTEN compositions, including the XTEN of the CFXTEN fusion protein compositions, substantially unable to be bound by mammalian receptors, including those of the immune system or active clearance receptors that target FVIII. In one embodiment, an XTEN of a CFXTEN fusion protein can have >100 nM $K_d$ binding to a mammalian receptor, or greater than 500 nM $K_d$, or greater than 1 μM $K_d$ towards a mammalian cell surface receptor or circulating polypeptide receptor.

Additionally, the non-repetitive sequence and corresponding lack of epitopes of XTEN limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while an XTEN can make contacts with many different B cells over its extended sequence, each individual B cell may only make one or a small number of contacts with an individual XTEN due to the lack of repetitiveness of the sequence. Not being to be bound by any theory, XTENs typically have a much lower tendency to stimulate proliferation of B cells and thus an immune response. In one embodiment, the CFXTEN have reduced immunogenicity as compared to the corresponding FVIII that is not fused to an XTEN. In one embodiment, the administration of up to three parenteral doses of a CFXTEN to a mammal result in detectable anti-CFXTEN IgG at a serum dilution of 1:100 but not at a dilution of 1:1000. In another embodiment, the administration of up to three parenteral doses of a CFXTEN to a mammal result in detectable anti-FVIII IgG at a serum dilution of 1:100 but not at a dilution of 1:1000. In another embodiment, the administration of up to three parenteral doses of a CFXTEN to a mammal result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness is non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the CFXTEN compositions can remain in circulation for an increased period of time. In addition, it is believed, as schematically portrayed in FIG. 6, the flexible unstructured nature of XTEN provides steric shielding of FVIII regions proximal to the XTEN site of insertion and providing steric hindrance to binding by FVIII inhibitors.

In another aspect, a subject XTEN useful as a fusion partner has a high hydrodynamic radius; a property that in some embodiments confers a corresponding increased apparent molecular weight to the CFXTEN fusion protein incorporating the XTEN, while in other embodiments enhances steric hindrance to FVIII inhibitors and to anti-FVIII antibodies, reducing their ability to bind to CFXTEN. As detailed in Example 26, the linking of XTEN to therapeutic protein sequences results in CFXTEN compositions that can have increased hydrodynamic radii, increased apparent molecular weight, and increased apparent molecular weight factor compared to a therapeutic protein not linked to an XTEN. For example, in therapeutic applications in which prolonged half-life is desired, compositions in which an XTEN with a high hydrodynamic radius is incorporated into a fusion protein comprising a therapeutic protein can effectively enlarge the hydrodynamic radius of the composition beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins with a corresponding increase in terminal half-life and other enhanced pharmacokinetic properties. The hydrodynamic radius of a protein is conferred by its molecular weight as well as by its structure, including shape or compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294, 513. Example 26 demonstrates that increases in XTEN length result in proportional increase in the hydrodynamic radius, apparent molecular weight, and/or apparent molecular weight factor, and thus permit the tailoring of CFXTEN to desired cut-off values of apparent molecular weights or hydrodynamic radii. Accordingly, in certain embodiments, the CFXTEN fusion protein can be configured with an XTEN such that the fusion protein can have a hydrodynamic radius of at least about 5 nm, or at least about 8 nm, or at least about 10 nm, or about 12 nm, or about 15 nm, or about 20 nm, or about 30 nm or more. In the foregoing embodiments, the large hydrodynamic radius conferred by the XTEN in a CFXTEN fusion protein can lead to reduced clearance of the resulting fusion protein, an increase in terminal half-life, and an increase in mean residence time.

Generally, the actual molecular weight of the mature form of FVIII component is about 265 kDa, while in the case of a FVIII BDD, it is about 165 kDa. The actual molecular weight of a CFXTEN fusion protein for comprising a FVIII BDD plus one or more XTEN ranges from about 200 to about 270 kDa, depending on the length of the XTEN components. As described in the Examples, when the molecular weights of the CFXTEN fusion proteins are derived from size exclusion chromatography analyses, the open conformation of the XTEN due to the low degree of secondary structure results in an increase in the apparent molecular weight of the fusion proteins into which they are incorporated. In some embodiments, the CFXTEN comprising a FVIII and at least one or more XTEN exhibits an apparent molecular weight of at least about 400 kD, or at least about 500 kD, or at least about 700 kD, or at least about 1000 kD, or at least about 1400 kD, or at least about 1600 kD, or at least about 1800 kD, or at least about 2000 kD. Accordingly, the CFXTEN fusion proteins comprising one or more XTEN exhibit an apparent molecular weight that is about 1.3-fold greater, or about 2-fold greater, or about 3-fold greater or about 4-fold greater, or about 8-fold greater, or about 10-fold greater, or about 12-fold greater, or about 15-fold greater than the actual molecular weight of the fusion protein. In one embodiment, the isolated CFXTEN fusion protein of any of the embodiments disclosed herein exhibit an apparent molecular weight factor under physiologic conditions that is greater than about 1.3, or about 2, or about 3, or about 4, or about 5, or about 6, or about 7, or about 8, or about 10, or greater than about 15. In another embodiment, the CFXTEN fusion protein has, under physiologic conditions, an apparent molecular weight factor that is about 3 to about 20, or is about 5 to about 15, or is about 8 to about 12, or is about 9 to about 10 relative to the actual molecular weight of the fusion protein. It is believed that the increased apparent molecular weight of the subject CFXTEN compositions enhances the pharmacokinetic properties of the fusion proteins by a combination of factors, which include reduced active clearance, reduced binding by FVIII inhibitors, and reduced loss in capillary and venous bleeding.

IV). CFXTEN Compositions

The present invention provides compositions comprising fusion proteins having factor VIII linked to one or more XTEN sequences, wherein the fusion protein acts to replace or augment the amount of existing FVIII in the intrinsic or contact activated coagulation pathway when administered into a subject. The invention addresses a long-felt need in increasing the terminal half-life of exogenously administered factor VIII to a subject in need thereof. One way to increase the circulation half-life of a therapeutic protein is to ensure that renal clearance or metabolism of the protein is reduced. Another way to increase the terminal half-life is to reduce the active clearance of the therapeutic protein, whether mediated by receptors, active metabolism of the protein, or other endogenous mechanisms. Both may be achieved by conjugating the protein to a polymer, which, on one hand, is capable of conferring an increased molecular size (or hydrodynamic radius) to the protein and, hence, reduced renal clearance, and, on the other hand, interferes with binding of the protein to clearance receptors or other proteins that contribute to metabolism or clearance. Thus, certain objects of the present invention include, but are not limited to, providing improved FVIII molecules with a longer circulation or terminal half-life, decreasing the number or frequency of necessary administrations of FVIII compositions, retaining at least a portion of the activity compared to native coagulation factor VIII, and/or enhancing the ability to treat coagulation deficiencies and uncontrolled bleedings more efficiently, more effectively, more economically, and/or with greater safety compared to presently available factor VIII preparations.

Accordingly, the present invention provides recombinant factor VIII fusion protein compositions comprising an FVIII covalently linked to one or more extended recombinant polypeptides ("XTEN"), resulting in a CFXTEN fusion protein composition. The term "CFXTEN", as used herein, is meant to encompass fusion polypeptides that comprise at least one payload region comprising a FVIII or a portion of a FVIII that is capable of procoagulant activity associated with a FVIII coagulation factor and at least one other region comprising one or more XTEN polypeptides that may be interspersed within the payload region and/or attached to the terminus. In one embodiment, the FVIII is native FVIII. In another embodiment, the FVIII is a sequence variant, fragment, homolog, or mimetic of a natural sequence that retains at least a portion of the procoagulant activity of native FVIII, as disclosed herein. Non-limiting examples of FVIII suitable for inclusion in the compositions include the sequences of Table 1 or sequences having at least 80%, or at least 90%, or at least 91%, or at least 92%, or at least 93%, or at least 94%, or at least 95%, or at least 96%, or at least 97%, or at least 98%, or at least 99% sequence identity to a sequence of Table 1. In a preferred embodiment, the FVIII is a B-domain deleted (BDD) FVIII sequence variant, such as those BDD sequences from Table 1 or other such sequences known in the art. In another preferred embodiment, the CFXTEN comprises a B-domain deleted (BDD) FVIII sequence variant expressed with the native 19 amino acid signal sequence, which is cleaved during the maturation of the protein.

The compositions of the invention include fusion proteins that are useful, when administered to a subject in need thereof, for mediating or preventing or ameliorating a condition associated with factor VIII deficiencies or defects in endogenously produced FVIII, or bleeding disorders associated with trauma, surgery, factor VIII deficiencies or defects. Of particular interest are CFXTEN fusion protein compositions for which an increase in a pharmacokinetic parameter, increased solubility, increased stability, or some other enhanced pharmaceutical property compared to native FVIII is sought, or for which increasing the terminal half-life would improve efficacy, safety, or result in reduced dosing frequency and/or improve patient management. The CFXTEN fusion proteins of the embodiments disclosed herein exhibit one or more or any combination of the improved properties and/or the embodiments as detailed herein. In some embodiments, the CFXTEN fusion composition remains at a level above a threshold value of at least 0.01-0.05, or 0.05 to 0.1, or 0.1 to 0.4 IU/ml when administered to a subject, for a longer period of time when compared to a FVIII not linked to XTEN and administered at a comparable dose to a subject in need thereof (e.g., a subject such as a human or mouse or monkey with hemophilia A).

The FVIII of the subject compositions, particularly those disclosed in Table 1, together with their corresponding nucleic acid and amino acid sequences, are available in public databases such as Chemical Abstracts Services Databases (e.g., the CAS Registry), GenBank, The Universal Protein Resource (UniProt), subscription provided databases such as GenSeq (e.g., Derwent), as well as in the patent and primary literature. Polynucleotide sequences applicable for expressing the subject CFXTEN sequences may be a wild type polynucleotide sequence encoding a given FVIII (e.g., either full length or mature), or in some instances the sequence may be a variant of the wild type polynucleotide sequence (e.g., a polynucleotide which encodes the wild type biologically active protein, wherein the DNA sequence of the polynucleotide has been optimized, for example, for expression in a particular species, or a polynucleotide encoding a variant of the wild type protein, such as a site directed mutant or an allelic variant. It is well within the ability of the skilled artisan to use a wild-type or consensus cDNA sequence or a codon-optimized variant of a FVIII to create CFXTEN constructs contemplated by the invention using methods known in the art and/or in conjunction with the guidance and methods provided herein, and described more fully in the Examples.

In one embodiment, a CFXTEN fusion protein comprises a single FVIII molecule exhibiting at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence of Table 1 linked to a single XTEN (e.g., an XTEN as described above) including, but not limited to sequences of the AE or AG family with 42, 144, 288, 576, or 864 amino acids, as set forth in Table 4. In another embodiment, the CFXTEN comprises a single FVIII linked to two XTEN, wherein the XTEN may be identical or they may be different. In another embodiment, the CFXTEN fusion protein comprises a single FVIII molecule linked to one, two, three, four, five, six or more XTEN sequences, in which the FVIII is a sequence that has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to a protein sequence selected from Table 1, when optimally aligned, and the one or more XTEN are each having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to one or more sequences selected from any one of Tables 3, 4, and 13-17, when optimally aligned. In the foregoing embodiment, where the CFXTEN has two or more XTEN, the XTEN may be identical or they may be different sequences. In yet another embodiment, the CFXTEN fusion protein comprises a single FVIII exhibiting at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to sequences of comparable length selected from Table 1, when optimally aligned, with the portions interspersed with and linked by three, four, five, six or more XTEN sequences that may be identical or may be different and wherein each has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity compared to sequences selected from any one of Tables 3, 4, and 13-17, or fragments thereof, when optimally aligned. In yet another embodiment, the invention provides a CFXTEN fusion protein comprising a sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, or at least about 99%, or 100% sequence identity to a sequence from Table 21, when optimally aligned.

1. CFXTEN Fusion Protein Configurations

The invention provides CFXTEN fusion protein compositions with the CF and XTEN components linked in specific N- to C-terminus configurations.

In one embodiment of the CFXTEN composition, the invention provides a fusion protein of formula I:

$$(XTEN)_x\text{-}CF\text{-}(XTEN)_y \quad\quad\quad I$$

wherein independently for each occurrence, CF is a factor VIII as defined herein, including sequences having at least about 80%, or at least about 90%, or at least about 95%, or at least about 96%, or at least about 97%, or at least about 98%, or at least about 99% or 100% sequence identity with sequenced from Table 1; x is either 0 or 1 and y is either 0 or 1 wherein x+y≥1; and XTEN is an extended recombinant polypeptide as described herein, including, but not limited to sequences having at least about 80%, or at least about 90%, or at least about 95%, or at least about 96%, or at least about 97%, or at least about 98%, or at least about 99% or 100% sequence identity to sequences set forth in Table 4. Accordingly, the CFXTEN fusion composition can have XTEN-CF, XTEN-CF-XTEN, or CF-XTEN configurations.

In another embodiment of the CFXTEN composition, the invention provides a fusion protein of formula II:

$$(XTEN)_x\text{-}(S)_x\text{-}(CF)\text{-}(XTEN)_y \quad\quad\quad II$$

wherein independently for each occurrence, CF is a factor VIII as defined herein, including sequences having at least about 80%, or at least about 90%, or at least about 95%, or at least about 96%, or at least about 97%, or at least about 98%, or at least about 99% or 100% sequence identity to sequences set forth in Table 1; S is a spacer sequence having between 1 to about 50 amino acid residues that can optionally include a cleavage sequence or amino acids compatible with restrictions sites; x is either 0 or 1 and y is either 0 or 1 wherein x+y≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4.

In another embodiment of the CFXTEN composition, the invention provides a recombinant factor VIII fusion protein, wherein the fusion protein is of formula III:

$$(XTEN)_x\text{-}(S)_x\text{-}(CF)\text{-}(S)_y\text{-}(XTEN)_y \quad\quad\quad III$$

wherein independently for each occurrence, CF is a factor VIII as defined herein, including sequences having at least about 80%, or at least about 90%, or at least about 95%, or at least about 96%, or at least about 97%, or at least about 98%, or at least about 99% or 100% sequence identity to sequence set for in Table 1; S is a spacer sequence having between 1 to about 50 amino acid residues that can optionally include a cleavage sequence or amino acids compatible with restrictions sites; x is either 0 or 1 and y is either 0 or 1 wherein x+y≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4.

In another embodiment of the CFXTEN composition, the invention provides a recombinant factor VIII fusion protein of formula IV:

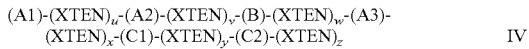

wherein independently for each occurrence, A1 is an A1 domain of FVIII; A2 is an A2 domain of FVIII; A3 is an A3 domain of FVIII; B is a B domain of FVIII which can be a fragment or a splice variant of the B domain; C1 is a C1 domain of FVIII; C2 is a C2 domain of FVIII; v is either 0 or 1; w is either 0 or 1; x is either 0 or 1; y is either 0 or 1; y is either 0 or 1 with the proviso that u+v+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4.

In another embodiment of the CFXTEN composition, the invention provides a recombinant factor VIII fusion protein of formula V:

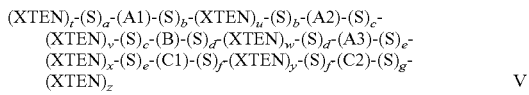

wherein independently for each occurrence, A1 is an A1 domain of FVIII; A2 is an A2 domain of FVIII; A3 is an A3 domain of FVIII; B is a B domain of FVIII which can be a fragment or a splice variant of the B domain; C1 is a C1 domain of FVIII; C2 is a C2 domain of FVIII; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; g is either 0 or 1; t is either 0 or 1; u is either 0 or 1; v is either 0 or 1; w is 0 or 1, x is either 0 or 1; y is either 0 or 1; z is either 0 or 1 with the proviso that t+u+v+w+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4. In another embodiment of formula V, the spacer sequence is glycine or a sequence selected from Tables 11 and 12.

In another embodiment of the CFXTEN composition, the invention provides a recombinant factor VIII fusion protein of formula VI:

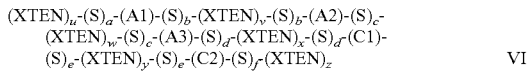

wherein independently for each occurrence, A1 is an A1 domain of FVIII; A2 is an A2 domain of FVIII; A3 is an A3 domain of FVIII; C1 is a C1 domain of FVIII; C2 is a C2 domain of FVIII; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; u is either 0 or 1; v is either 0 or 1; w is 0 or 1, x is either 0 or 1; y is either 0 or 1; z is either 0 or 1 with the proviso that u+v+w+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4. In another embodiment of formula V, the spacer sequence is glycine or a sequence selected from Tables 11 and 12.

In another embodiment of the CFXTEN composition, the invention provides a recombinant factor VIII fusion protein of formula VII:

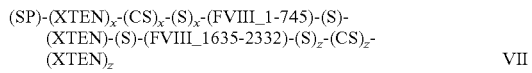

wherein independently for each occurrence, SP is a signal peptide, preferably with sequence MQIELSTCFFLCLLR-FCFS (SEQ ID NO: 1611), CS is a cleavage sequence listed in Table 12, S is a spacer sequence having between 1 to about 50 amino acid residues that can optionally include amino acids compatible with restrictions sites, "FVIII_1-745" is residues 1-745 of Factor FVIII and "FVIII_1635-2332" is residues 1635-2332 of FVIII, x is either 0 or 1, y is either 0 or 1, and z is either 0 or 1, wherein x+y+z>2; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity sequences set forth in Table 4. In one embodiment of formula VII, the spacer sequence is GPEGPS (SEQ ID NO: 1612). In another embodiment of formula V, the spacer sequence is glycine or a sequence selected from Tables 11 and 12.

In another embodiment of the CFXTEN composition, the invention provides a recombinant factor VIII fusion protein of formula VIII:

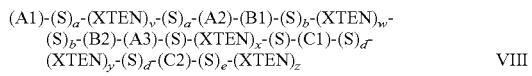

wherein independently for each occurrence, A1 is an A1 domain of FVIII; A2 is an A2 domain of FVIII; B1 is a fragment of the B domain that can have from residue 741 to 743-750 of FVIII or alternatively from about residue 741 to about residues 745 of FVIII; B2 is a fragment of the B domain that can have from residues 1635-1686 to 1689 of FVIII or alternatively from about residue 1640 to about residues 1689 of FVIII; A3 is an A3 domain of FVIII; C1 is a C1 domain of FVIII; C2 is a C2 domain of FVIII; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; u is either 0 or 1; v is either 0 or 1; w is 0 or 1, x is either 0 or 1; y is either 0 or 1; z is either 0 or 1 with the proviso that u+v+w+x+y+z≥1; and XTEN is an extended recombinant polypeptide as described herein including, but not limited to sequences having at least about 80%, or at least about 90%, or at least about 95%, or at least about 96%, or at least about 97%, or at least about 98%, or at least about 99% or 100% sequence identity to sequences set forth in Table 4. In one embodiment of formula VIII, the spacer sequence is GPEGPS (SEQ ID NO: 1612). In another embodiment of formula V, the spacer sequence is glycine or a sequence selected from Tables 11 and 12.

In another embodiment of the CFXTEN composition, the invention provides a recombinant factor VIII fusion protein of formula IX:

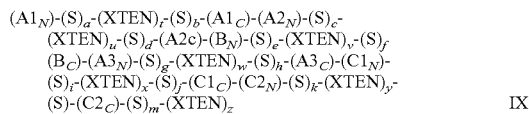

$$(A1_N)\text{-}(S)_a\text{-}(XTEN)_t\text{-}(S)_b\text{-}(A1_C)\text{-}(A2_N)\text{-}(S)_c\text{-}$$
$$(XTEN)_u\text{-}(S)_d\text{-}(A2c)\text{-}(B_N)\text{-}(S)_e\text{-}(XTEN)_v\text{-}(S)_f\text{-}$$
$$(B_C)\text{-}(A3_N)\text{-}(S)_g\text{-}(XTEN)_w\text{-}(S)_h\text{-}(A3_C)\text{-}(C1_N)\text{-}$$
$$(S)_i\text{-}(XTEN)_x\text{-}(S)_j\text{-}(C1_C)\text{-}(C2_N)\text{-}(S)_k\text{-}(XTEN)_y\text{-}$$
$$(S)\text{-}(C2_C)\text{-}(S)_m\text{-}(XTEN)_z \qquad \text{IX}$$

wherein independently for each occurrence, $A1_N$ is a fragment of the A1 domain from at least residue number 1 (numbered relative to native, mature FVIII) to no more than residue number 371, A1 is a fragment of the A1 domain from at least residue number 2 to no more than residue number 372; $A2_N$ is a fragment of the A2 domain from at least residue number 373 to no more than residue number 739, $A2_c$ is a fragment of the A2 domain from at least residue number 374 to no more than residue number 740; $B_N$ is a fragment of the B domain from at least residue number 741 to no more than residue number 1647, Be is a fragment of the B domain from at least residue number 742 to no more than residue number 1648; $A3_N$ is a fragment of the A3 domain from at least residue number 1649 to no more than residue number 2019, A3, is a fragment of the A3 domain from at least residue number 1650 to no more than residue number 2019; $C1_N$ is a fragment of the C1 domain from at least residue number 2020 to no more than residue number 2171, C1, is a fragment of the C1 domain from at least residue number 2021 to no more than residue number 2172; $C2_N$ is a fragment of the C2 domain from at least residue number 2173 to no more than residue number 2331, C2, is a fragment of the C2 domain from at least residue number 2174 to no more than residue number 2332; S is a spacer sequence having between 1 to about 50 amino acid residues that can optionally include a cleavage sequence or amino acids compatible with restrictions sites; a is either 0 or 1; b is either 0 or 1; c is either 0 or 1; d is either 0 or 1; e is either 0 or 1; f is either 0 or 1; g is either 0 or 1; h is either 0 or 1; i is either 0 or 1; j is either 0 or 1; k is either 0 or 1; 1 is either 0 or 1; m is either 0 or 1; t is either 0 or 1; u is either 0 or 1; v is either 0 or 1; w is 0 or 1, x is either 0 or 1; y is either 0 or 1; z is either 0 or 1 with the proviso that t+u+v+w+x+y+z≥1; and XTEN is an extended recombinant polypeptide as described herein including, but not limited to sequences having at least 90% identity to sequences set forth in Table 4. In one embodiment of formula IX, the spacer sequence is GPEGPS (SEQ ID NO: 1612). In another embodiment of formula IX, the spacer sequence is glycine or a sequence selected from Tables 11 and 12.

The embodiments of formulae IV-VIII encompass CFXTEN configurations wherein one or more XTEN of lengths ranging from about 6 amino acids to ≥1000 amino acids (e.g., sequences selected from any one of Tables 3, 4, and 13-17 or fragments thereof, or sequences exhibiting at least about 90-99% or more sequence identity thereto) are inserted and linked between adjoining domains of the factor VIII or are linked to the N- or C-terminus of the FVIII. In other embodiments of formulae V-VIII, the invention further provides configurations wherein the XTEN are linked to FVIII domains via spacer sequences which can optionally comprise amino acids compatible with restrictions sites or can include cleavage sequences (e.g., the sequences of Tables 11 and 12, described more fully below) such that the XTEN encoding sequence can be, in the case of a restriction site, integrated into a CFXTEN construct and, in the case of a cleavage sequence, the XTEN can be released from the fusion protein by the action of a protease appropriate for the cleavage sequence.

The embodiments of formulae VI-VIII differ from those of formula V in that the FVIII component of formulae VI-VIII are only the B-domain deleted forms ("FVIII BDD") of factor VIII that retain short residual sequences of the B-domain, non-limiting examples of sequences of which are provided in Table 1, wherein one or more XTEN or fragments of XTEN of lengths ranging from about 6 amino acids to ≥1000 amino acids (e.g., sequences selected from any one of Tables 3, 4, and 13-17) are inserted and linked between adjoining domains of the factor VIII and/or between the remnants of the B domain residues, such as those of Table 8. The embodiment of formula IX generally differs from those of the other formulae in that the one or more XTEN are each inserted within domains of FVIII rather than between domains, and/or has an XTEN linked to the C-terminus of the FVIII (or is linked via a spacer sequence to the C-terminus of the FVIII).

In some embodiments of a CFXTEN, the fusion protein comprises a B-domain deleted form of FVIII wherein the B-domain deletion starts from a first position at about amino acid residue number 745 and ends at a second position at amino acid residue number 1635 to about 1690 with reference to the full-length human factor VIII sequence and an XTEN links the first position and the second position of the B-domain deletion. In one embodiment of the foregoing, the first position and the second position of the B-domain deletion are selected from the positions of Table 8. In another embodiment of the foregoing, at least one XTEN links the first and second position wherein the at least one XTEN links factor VIII amino acid residue 745 and amino acid residue 1640, or amino acid residue 741 and amino acid residue 1640, or amino acid residue 741 and amino acid residue 1690, or amino acid residue 745 and amino acid residue 1667, or amino acid residue 745 and amino acid residue 1657, or amino acid residue 745 and amino acid residue 1657, or amino acid residue 747 and amino acid residue 1642, or amino acid residue 751 and amino acid residue 1667. In one embodiment of the CFXTEN, wherein the factor VIII comprises an XTEN linking a first position and a second position of a B-domain deletion described in the embodiments of this paragraph, the XTEN is a sequence having at least 80%, or at least about 90%, or at least about 95%, or at least about 96%, or at least about 97%, or at least about 98%, or at least about 99% or 100% sequence identity compared to a sequence of comparable length selected from any one of Table 4, Table 13, Table 14, Table 15, Table 16, and Table 17, when optimally aligned, wherein the CFXTEN retains at least about 30%, or at least about 40%, or at least about 50%, or at least about 60%, or at least about 70%, or at least about 80%, or at least about 90% of the procoagulant activity of native FVIII.

Figure 5:
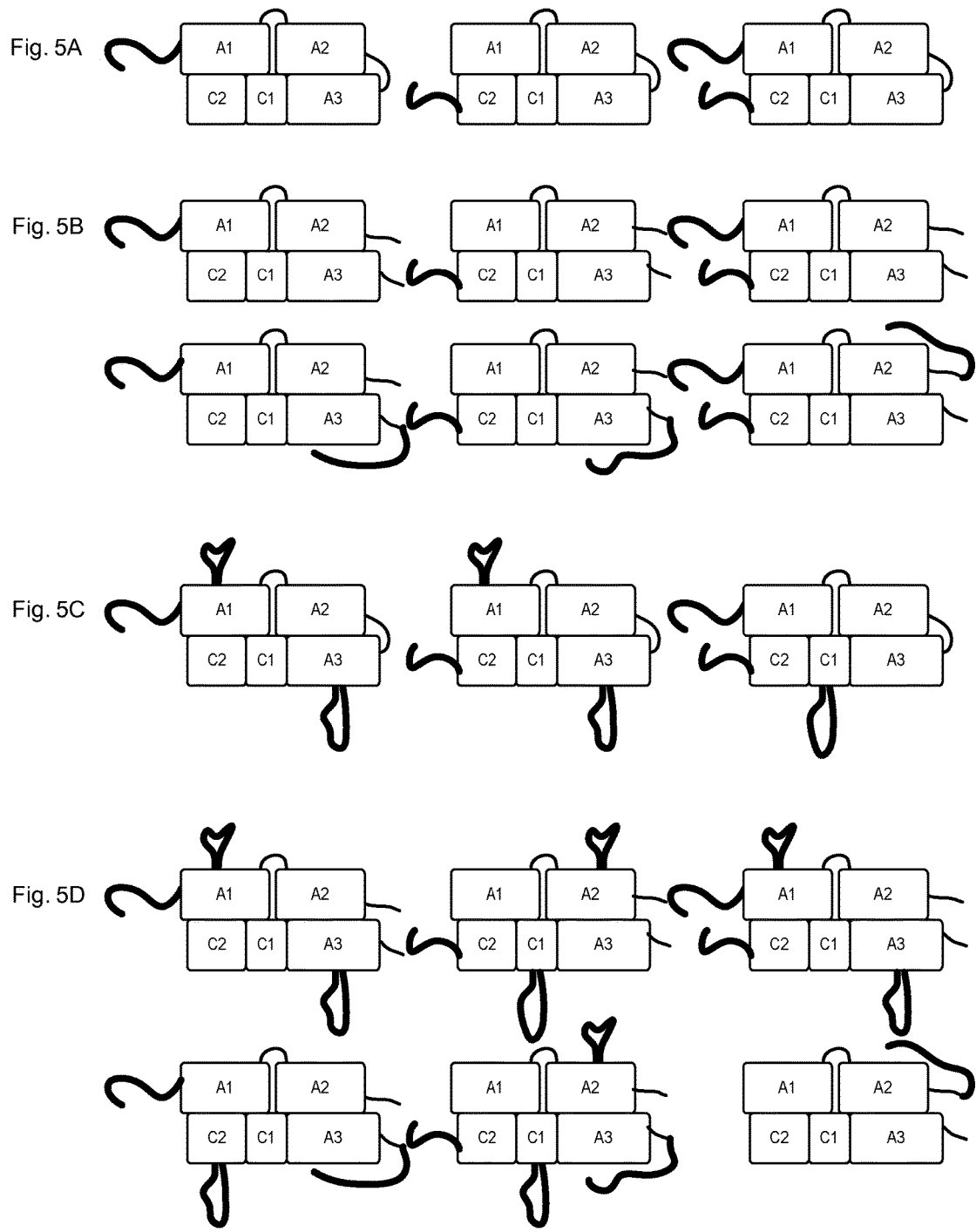
FIG. 5 illustrates several examples of CFXTEN configurations of FVIII linked to XTEN (the latter shown as thick, wavy lines). In all cases, the FVIII can be either native or a BDD form of FVIII, or a single chain form in which the entire B domain, including the native cleavage sites are removed.
Figure 12:
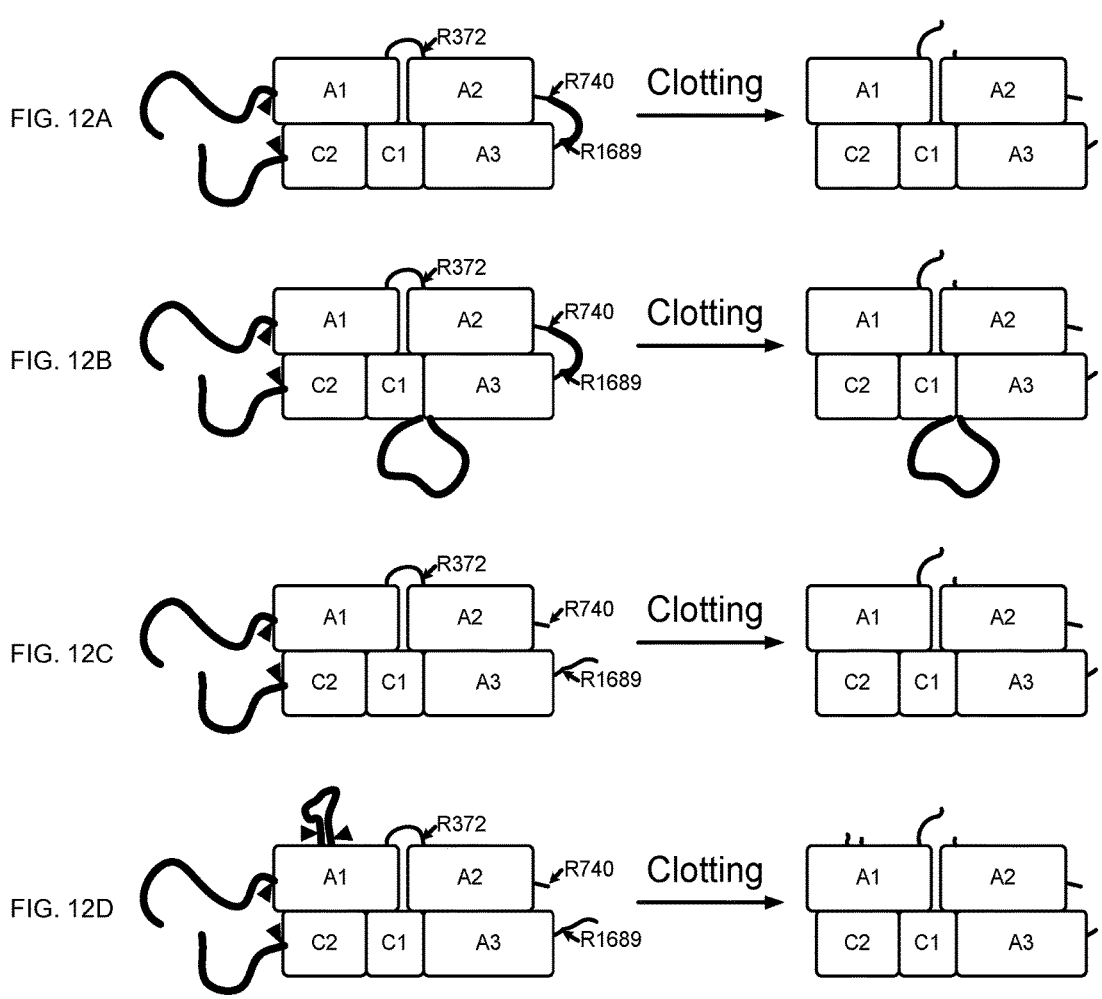

The invention contemplates all possible permutations of insertions of XTEN between or within the domains of FVIII or at or proximal to the insertion points of Table 5, Table 6, Table 7, Table 8, and Table 9 or those illustrated in FIGS. 8-9, with optional linking of an additional XTEN to the N- or C-terminus of the FVIII, optionally linked via an additional cleavage sequence selected from Table 12, resulting in a CFXTEN composition; non-limiting examples of which are portrayed in FIGS. 5 and 12.

In one embodiment, the CFXTEN comprises a FVIII BDD sequence of Table 1 in which one or more XTEN that each has at least about 80%, or at least about 90%, or at least about 95%, or at least about 96%, or at least about 97%, or at least about 98%, or at least about 99% or more sequence identity compared to a sequence from any one of Tables 3, 4, and 13-17 or fragments thereof are inserted between any two of the residual B domain amino acids of the FVIII BDD sequence, resulting in a single chain FVIII fusion protein, wherein the CFXTEN retains at least about 30%, or at least about 40%, or at least about 50%, or at least about 60%, or at least about 70%, or at least about 80%, or at least about 90% of the procoagulant activity of native FVIII. In the foregoing embodiment, the CFXTEN can have an additional XTEN sequence of any one of Tables 4, and 13-17 linked to the N- or C-terminus of the fusion protein. In another embodiment, a CFXTEN comprises at least a first XTEN inserted at a site set forth in Table 8, wherein the CFXTEN retains at least about 30%, or at least about 40%, or at least about 50%, or at least about 60%, or at least about 70%, or at least about 80%, or at least about 90% of the procoagulant activity of native FVIII. In one embodiment of a fusion protein of formula VII, the CFXTEN comprises a FVIII BDD sequence of Table 1 in which two or more XTEN that each has at least about 80%, or at least about 90%, or at least about 95%, or at least about 96%, or at least about 97%, or at least about 98%, or at least about 99%, or 100% sequence identity compared to a sequence from any one of Tables 3, 4, and 13-17 or fragments thereof are linked to a FVIII-BDD sequence in which at least one XTEN is inserted from about 3 to about 20 amino acid residues to the C-terminus side of the FVIII cleavage site amino acid R740 and from about 3 to about 20 amino acid residues to the N-terminus side of the FVIII cleavage site amino acid R1689 of the residual B domain amino acids of the FVIII BDD sequence, resulting in a single chain FVIII fusion protein, and one or two XTEN are linked by a cleavage sequence to the N- and/or C-terminus of the FVIII-BDD sequence, wherein the CFXTEN exhibits at least about 40%, or at least about 50%, or at least about 60%, or at least about 70%, or at least about 80%, or at least about 90% of the procoagulant activity of native FVIII after release of the XTEN by cleavage of the cleavage sequences.

In one embodiment, the A3 domain comprises an a3 acidic region or a portion thereof. In another embodiment, at least one XTEN is inserted within the a3 acidic region or the portion thereof, N-terminus of the a3 acidic region or the portion thereof, C-terminus of the a3 acidic region or the portion thereof, or a combination thereof. In certain embodiments, at least one XTEN is inserted within the C2 domain, N-terminus of C2 domain, C-terminus of C2 domain, or a combination thereof. In still other embodiments, the Factor VIII comprises all or portion of B domain. In yet other embodiments, at least one XTEN is inserted within all or a portion of B domain, N-terminus of B domain, C-terminus of B domain, or a combination thereof.

2. CFXTEN Fusion Protein Configurations with Internal XTEN

In another aspect, the invention provides CFXTEN configured with one or more XTEN sequences located internal to the FVIII sequence. In one embodiment, invention provides CFXTEN configured with one or more XTEN sequences located internal to the FVIII sequence to confer properties such as, but not limited to, increased stability, increased resistance to proteases, increased resistance to clearance mechanisms including but not limiting to interaction with clearance receptors or FVIII inhibitors, and increased hydrophilicity, compared to FVIII without the incorporated XTEN.

The invention contemplates that different configurations or sequence variants of FVIII can be utilized as the platform into which one or more XTEN are inserted. These configurations include, but are not limited to, native FVIII, FVIII BDD, and single chain FVIII (scFVIII), and variants of those configurations. In the case of scFVIII, the invention provides CFXTEN that can be constructed by replacing one or multiple amino acids of the processing site of FVIII. In one embodiment, the scFVIII utilized in the CFXTEN is created by replacing the R1648 in the FVIII sequence RHQREITR (SEQ ID NO: 1698) with glycine or alanine to prevent proteolytic processing to the heterodimer form. It is specifically contemplated that any of the CFXTEN embodiments disclosed herein with a 1648 FVIII residue can have a glycine or alanine substitution for the arginine at position 1648. In some embodiments, the invention provides CFXTEN comprising scFVIII wherein parts of the sequence surrounding the R1648 processing site are replaced with XTEN, as illustrated in FIGS. 10A and 10B. In one embodiment, at least about 60%, or about 70%, or about 80%, or about 90%, or about 95%, or about 97% or more of the B-domain is replaced with an XTEN sequence disclosed herein, including one or more of the R740, R1648, or R1689 cleavage sites. In another embodiment, the CFXTEN has the FVIII sequence of the B-domain between the FXIa cleavage sites at R740 and R1689 (with at least 1-5 adjacent B-domain amino acids also retained between the cut site and the start of the XTEN to permit the protease to access the cut site) replaced with XTEN. In another embodiment, the CFXTEN has the FVIII sequence of the B-domain between the FXIa cleavage site at N745 and P1640 replaced with XTEN. In other embodiments, the invention provides CFXTEN FVIII BDD sequence variants in which portions of the B-domain are deleted but only one of the FXI R740 or R1689 activation sites (and 1-5 adjacent amino acids of the B-domain) are left within the construct, wherein the XTEN remains attached at one end to either the light or heavy chain after cleavage by FXIa, as illustrated in FIGS. 5B and 5D. In one embodiment of the foregoing, the CFXTEN comprises a FVIII BDD sequence in which the amino acids between N745 to P1640 or between S743 to Q1638 or between P747 to V1642 or between N745 and Q1656 or between N745 and S1657 or between N745 and T1667 or between N745 and Q1686 or between R747 and V1642 or between T751 and T1667 are deleted and an XTEN sequence is linked between these amino acids, connecting the heavy and light chains, and can further comprise additional XTEN inserted either in external surface loops, between FVIII domains, or at the N- or C-termini of the FVIII BDD sequence, such as one or more insertion sites from Table 5, Table 6, Table 7, Table 8, and Table 9 or those illustrated in FIGS. 8-9. In another embodiment of the foregoing, the CFXTEN comprises a FVIII BDD sequence in which the amino acids between K713 to Q1686 or between residues 741 and 1648 are deleted and an XTEN linked between the two amino acids, and additional XTEN can be inserted either in surface loops, between FVIII domains, or at the N- or C-termini of the FVIII BDD sequence, including but not limited to one or more insertion sites from Table 5, Table 6, Table 7, Table 8, and Table 9 or those illustrated in FIGS. 8-9. In some embodiments such CFXTEN sequences can have one or more XTEN exhibiting at least about 80%, or at least about 90%, or at least about 95%, or at least about 96%, or at least about 97%, or at least about 98%, or at least about 99%, or 100% sequence identity to an XTEN sequence from any one of Tables 4 and 13-17.

Figure 7:
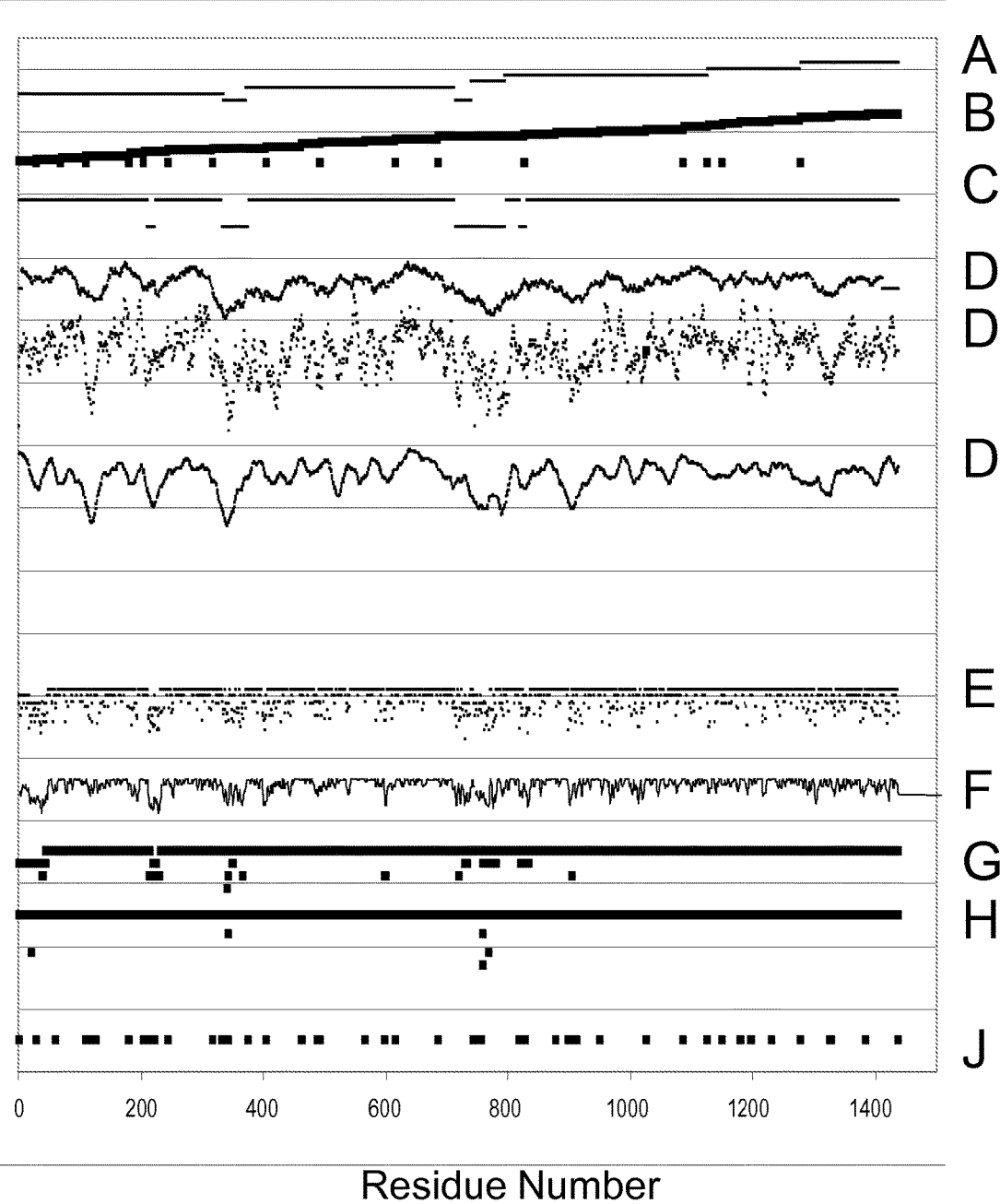
FIG. 7 is a graphic portrayal of the various anal into a BsaI/HindIII digested vector containing a gene encoding the FVIII, resulting in the gene 500 encoding an FVIII-XTEN fusion protein.
Figure 10:
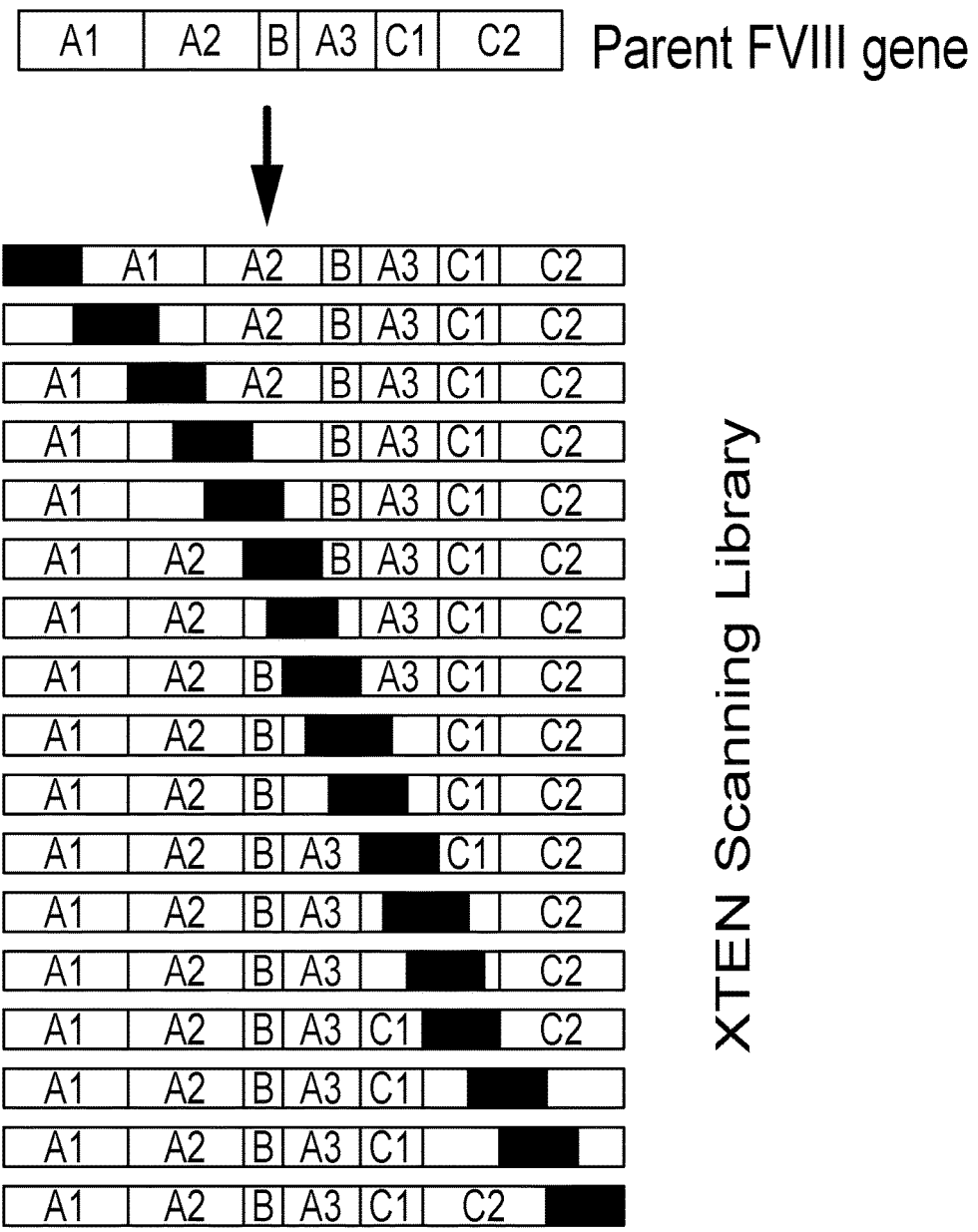

The invention contemplates other CFXTEN with internal XTEN in various configurations; schematics of exemplary configurations are illustrated in FIGS. 5 and 10. The regions suitable for XTEN insertion sites include the known domain boundaries of FVIII, exon boundaries, known surface (external) loops and solvent accessible surface area sites identified by X-ray crystallography analysis, and structure models derived from molecular dynamic simulations of FVIII, regions with a low degree of order (assessed by programs described in FIG. 7 legend), regions of low homology/lack of conservation across different species, and hydrophilic regions. In another embodiment, XTEN insertion sites were selected based on FVIII putative clearance receptor binding sites. In another embodiment, CFXTEN comprises XTEN inserted at locations not within close proximity to mutations implicated in hemophilia A listed in the Haemophilia A Mutation, Search, Test and Resource Site (HAMSTeRS) database were eliminated (Kemball-Cook G, et al. The factor VIII Structure and Mutation Resource Site: HAMSTeRS version 4. Nucleic Acids Res. (1998) 26(1):216-219). In another embodiment, potential sites for XTEN insertion include residues within FVIII epitopes that are capable of being bound by anti-FVIII antibodies occurring in sensitized hemophiliacs and that do not otherwise serve as protein interactive sites. Regions and/or sites that are considered for exclusion as XTEN insertion sites include residues/regions of factor VIII that are important in various interactions including other clotting proteins, residues surrounding each arginine activating/inactivating cleavage site acted on by the proteases thrombin, factor Xa, activated protein C, residues surrounding the signal peptide processing site (residue 1) if the construct contains the signal peptide, regions known to interact with other proteins such as FIXa, FX/FXa, thrombin, activated protein C, protein S cofactor to Protein C, von Willebrand factor, sites known to interact with phospholipid cofactors in coagulation, residues involved in domain interactions, residues coordinating $Ca^{++}$ or $Cu^{++}$ ions, cysteine residues involved in S—S intramolecular bonds, documented amino acid insertion and point mutation sites in FVIII produced in hemophilia A subjects affecting procoagulant activity, and mutation sites in FVIII made in a research lab that affect procoagulant activity. Sites considered for either insertion (to prolong half-life) or for exclusion (needed to remove spent FVIIIa or FXa) include regions known to interact with heparin sulfate proteoglycan (HSPG) or low-density lipoprotein receptor-related protein (LPR).

By analysis of the foregoing criteria, as described in Example 34, different insertion sites or ranges of insertions sites across the FVIII BDD sequence have been identified and/or confirmed as candidates for insertion of XTEN, non-limiting examples of which are listed in Table 5, Table 6, Table 7, Table 8, and Table 9 and are shown schematically in FIGS. 8 and 9. In one embodiment, CFXTEN comprise XTEN insertions between the individual domains of FVIII, i.e., between the A1 and A2, or between the A2 and the B, or between the B and the A3, or between the A3 and the C1, or between the C1 and the C2 domains. In another embodiment, CFXTEN comprises XTEN inserted within the B domain or between remnant residues of the BDD sequence. In another embodiment, CFXTEN comprises XTEN inserted at known exon boundaries of the encoding FVIII gene as exons represent evolutionary conserved sequence modules that have a high probability of functioning in the context of other protein sequences. In another embodiment, CFXTEN comprise XTEN inserted within surface loops identified by the x-ray structure of FVIII. In another embodiment, CFXTEN comprise XTEN inserted within regions of low order identified as having low or no detected electron density by X-ray structure analysis. In another embodiment, CFXTEN comprise XTEN inserted within regions of low order, predicted by structure prediction algorithms such as, but not limited to FoldIndex, RONN, and Kyte & Doolitlle algorithms. In another embodiment, CFXTEN comprise XTEN inserted within sequence areas of high frequency of hydrophilic amino acids. In another embodiment, CFXTEN comprise XTEN inserted within epitopes capable of being bound by naturally-occurring anti-FVIII antibodies in sensitized hemophiliacs. In another embodiment, CFXTEN comprise XTEN inserted within sequence areas of low sequence conservation and/or differences in sequence segment length across FVIII sequences from different species. In another embodiment, CFXTEN comprise XTEN linked to the N-terminus and/or C-terminus. In another embodiment, the invention provides CFXTEN configurations with inserted XTEN selected from two or more of the criteria from the embodiments listed above. In another embodiment, the invention provides CFXTEN configurations with at least one, alternatively at least two, alternatively at least three, alternatively at least four, alternatively at least five or more XTEN inserted into a factor VIII sequence wherein the points of insertion are at or proximal to the N- or C-terminus side of the at least one, two, three, four, or five, or six or more amino acids selected from the insertion residue amino acids of Table 5, Table 6, Table 7, Table 8, and Table 9 or those illustrated in FIGS. 8-9, or alternatively within one, or within two, or within three, or within four, or within five, or within six amino acids of the insertion residue amino acids from Table 5, Table 6, Table 7, Table 8, and Table 9, or within the various spans of the insertion residue amino acids schematically portrayed for an exemplary FVIII BDD sequence in FIG. 9.

As described above, the one or more internally-located XTEN or a fragment of XTEN can have a sequence length of 6 to 1000 or more amino acid residues. In some embodiments, wherein the CFXTEN have one or two or three or four or five or more XTEN sequences internal to the FVIII, the XTEN sequences can be identical or can be different. In one embodiment, each internally-located XTEN has at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to comparable lengths or fragments of XTEN or motifs selected from any one of Tables 3, 4, and 13-17, when optimally aligned. In another embodiment, the invention provides a CFXTEN configured with one or more XTEN inserted internal to a FVIII BDD sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence of Table 1, wherein the insertions are located at the insertion points or range of insertion points indicated in Table 5, Table 6, Table 7, Table 8, and Table 9, FIG. 8 or within the range of insertions as illustrated in FIG. 9. It will be understood by those of skill in the art that an XTEN inserted within the FVIII sequence at an insertion point of Table 5, Table 6, Table 7, Table 8, and Table 9 is linked by its N- and C-termini to flanking FVIII amino acids (or via a linking spacer or cleavage sequences, as described above), while an XTEN linked to the N- or C-terminus of FVIII would only be linked to a single FVIII amino acid (or to a linking spacer or cleavage sequence amino acid, as described above). By way of example only, variations of CFXTEN with three internal XTEN could have: XTEN (as described herein) incorporated between FVIII BDD residues 741 and 1640, residues 18 and 19, and residues 1656 and 1657; or XTEN incorporated between FVIII BDD residues 741 and 1640, residues 1900 and 1901, and at the C-terminus at residue 2332; or XTEN incorporated between FVIII BDD residues 26 and 27, residues 1656 and 1657, and residues 1900 and 1901; or XTEN incorporated between FVIII BDD residues 741 and 1640, residues 1900 and 1901, and at the C-terminus at residue 2332.

In evaluating the CFXTEN fusion proteins with XTEN inserted in the locations from Table 5, it was discovered that insertions in certain regions of the FVIII sequence resulted in CFXTEN with good expression and retention of procoagulant activity. Accordingly, in preferred embodiments, the invention provides CFXTEN fusion proteins configured with one, or two, or three, or four, or five, or six or more XTEN, each having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from any one of Tables 4, and 13-17 inserted internal or linked to a FVIII BDD sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence of Table 1, wherein the insertions are located at an insertion point within one, or two, or three, or four, or five, or six or more ranges set forth in Table 7. In the foregoing embodiments, the CFXTEN fusion proteins with the XTEN insertions retain at least about 10%, 20%, 30%, 40%, 50%, 60%, 70%, 80%, or 90% or more of the procoagulant activity compared to the corresponding FVIII not linked to XTEN.

In evaluating the CFXTEN fusion proteins with XTEN inserted in one or more locations from Table 5, it was surprisingly discovered that a high percentage of fusion proteins with the XTEN insertions retained procoagulant activity, as described in Example 25. Accordingly, the invention provides CFXTEN fusion proteins configured with one, two, three, four, five, six or more XTEN wherein the resulting fusion protein exhibits at least about 10%, or 20%, or 30%, or 40%, or 50%, or 60%, or 70%, or 80%, or 90% or more of the procoagulant activity compared to the corresponding FVIII not linked to XTEN when assayed by a coagulation assay described herein. In a preferred embodiment, the invention provides CFXTEN fusion proteins comprising one, or two, or three, or four, or five, or six or more XTEN, each having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from any one of Tables 4, and 13-17 linked to a FVIII BDD sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence of Table 1, wherein the insertions are located at one or more insertion points selected from Table 5, Table 6, Table 7, Table 8, and Table 9, and wherein the resulting fusion protein exhibits at least about 30%, or at least about 40%, or at least about 50%, or at least about 60%, or at least about 70% or more procoagulant activity compared to the corresponding FVIII not linked to XTEN, when assayed in vitro by an assay described herein (e.g., a chromogenic assay). As the subject CFXTEN fusion proteins typically exhibit increased terminal half-life compared to native FVIII, it will be appreciated by one of skill in the art that a CFXTEN with lower procoagulant activity relative to an equimolar amount of native FVIII would nevertheless be acceptable when administered as a therapeutic composition to a subject in need thereof. In another embodiment, the CFXTEN fusion proteins comprising one, or two, or three, or four, or five or more XTEN, each having at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to an XTEN selected from any one of Tables 4, and 13-17 linked to a FVIII BDD sequence with at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a sequence of Table 1, wherein the insertions are located at one or more insertion points or the range of insertion points selected from Table 5, Table 6, Table 7, Table 8, and Table 9, wherein the resulting fusion protein exhibits at least about 0.5 IU/ml, or at least about 0.75 IU/ml, or at least about 1.0 IU/ml, or at least about 1.5 IU/ml, or at least about 2.0 IU/ml, or at least about 2.5 IU/ml, or at least about 3 IU/ml, or at least about 4 IU/ml, or at least about 5 IU/ml, or at least about 7 IU/ml, or at least about 10 IU/ml, or at least about 20 IU/ml, or at least about 30 IU/ml FVIII activity when expressed in cell culture medium and assayed in a chromogenic assay, wherein the culture and expression are according to methods described herein; e.g., the methods of Example 25.

It is believed that the discovery of the insertions sites wherein the FVIII retains at least a portion of its procoagulant activity would also permit the insertion of other peptides and polypeptides with either unstructured or structured characteristics that are associated with the prolongation of half-life when fused to a FVIII protein in one or more of those same sites. Non-limiting examples include albumin, albumin fragments, Fc fragments of immunoglobulins, the 3 subunit of the C-terminal peptide (CTP) of human chorionic gonadotropin, a HAP sequence, a transferrin, the PAS polypeptides of U.S. Pat Application No. 20100292130, polyglycine linkers, polyserine linkers, peptides and short polypeptides of 6-40 amino acids of two types of amino acids selected from glycine (G), alanine (A), serine (S), threonine (T), glutamate (E) and proline (P) with varying degrees of secondary structure from less than 50% to greater than 50%, amongst others, would be suitable for insertion in the identified active insertions sites of FVIII.

In the fusion protein embodiments described herein, the CFXTEN fusion protein can further comprise one or more cleavage sequence from Table 12 or other sequences known in the art, the cleavage sequence being located between or within 6 amino acid residues of the intersection of the FVIII and the XTEN sequences, which may include two cleavage sequences in a given internal XTEN sequence. In one embodiment, the CFXTEN comprising cleavage sequences has two identical cleavage sequences, each located at or near the respective ends of one or more internal XTEN such that the XTEN is released from the fusion protein when cleaved by the protease that binds to and cleaves that sequence. The sequences that can be cleaved are described more fully below and exemplary sequences are provided

TABLE 5

Insertion locations for XTEN linked to the FVIII BDD sequence

| No. | XTEN Insertion Point | Insertion Residue | FVIII BDD Downstream Sequence | FVIII Domain |
|---|---|---|---|---|
| 1 | 0 | (N-terminus) | ATR | A1 |
| 2 | 3 | R | RYY | A1 |

TABLE 5-continued

Insertion locations for XTEN linked to the FVIII BDD sequence

| No. | XTEN Insertion Point | Insertion Residue | FVIII BDD Downstream Sequence | FVIII Domain |
|---|---|---|---|---|
| 3 | 17 | M | QSD | A1 |
| 4 | 18 | Q | SDL | A1 |
| 5 | 22 | G | ELP | A1 |
| 6 | 24 | L | PVD | A1 |
| 7 | 26 | V | DAR | A1 |
| 8 | 28 | A | RFP | A1 |
| 9 | 32 | P | RVP | A1 |
| 10 | 38 | F | PFN | A1 |
| 11 | 40 | F | NTS | A1 |
| 12 | 41 | N | TSV | A1 |
| 13 | 60 | N | IAK | A1 |
| 14 | 61 | I | AKP | A1 |
| 15 | 65 | R | PPW | A1 |
| 16 | 81 | Y | DTV | A1 |
| 17 | 111 | G | AEY | A1 |
| 18 | 116 | D | QTS | A1 |
| 19 | 119 | S | QRE | A1 |
| 20 | 120 | Q | REK | A1 |
| 21 | 128 | V | FPG | A1 |
| 22 | 129 | F | PGG | A1 |
| 23 | 130 | P | GGS | A1 |
| 24 | 182 | G | SLA | A1 |
| 25 | 185 | A | KEK | A1 |
| 26 | 188 | K | TQT | A1 |
| 27 | 205 | G | KSW | A1 |
| 28 | 210 | S | ETK | A1 |
| 29 | 211 | E | TKN | A1 |
| 30 | 216 | L | MQD | A1 |
| 31 | 220 | R | DAA | A1 |
| 32 | 222 | A | ASA | A1 |
| 33 | 223 | A | SAR | A1 |
| 34 | 224 | S | ARA | A1 |
| 35 | 230 | K | MHT | A1 |
| 36 | 243 | P | GLI | A1 |
| 37 | 244 | G | LIG | A1 |
| 38 | 250 | R | KSV | A1 |
| 39 | 318 | D | GME | A1 |
| 40 | 333 | P | QLR | A1 |
| 42 | 334 | Q | LRM | A1 |
| 43 | 336 | R | MKN | a1 |
| 44 | 339 | N | NEE | a1 |
| 45 | 345 | D | YDD | a1 |
| 46 | 357 | V | VRF | a1 |
| 47 | 367 | S | FIQ | a1 |
| 48 | 370 | S | RPY | a1 |
| 49 | 375 | A | KKH | A2 |
| 50 | 376 | K | KHP | A2 |
| 51 | 378 | H | PKT | A2 |
| 52 | 399 | V | LAP | A2 |
| 53 | 403 | D | DRS | A2 |
| 54 | 405 | R | SYK | A2 |
| 55 | 409 | S | QYL | A2 |
| 56 | 416 | P | QRI | A2 |
| 57 | 434 | E | TFK | A2 |
| 58 | 438 | T | REA | A2 |
| 59 | 441 | A | IQH | A2 |
| 60 | 442 | I | QHE | A2 |
| 61 | 463 | I | IFK | A2 |
| 62 | 487 | Y | SRR | A2 |
| 63 | 490 | R | LPK | A2 |
| 64 | 492 | P | KGV | A2 |
| 65 | 493 | K | GVK | A2 |
| 66 | 494 | G | VKH | A2 |
| 67 | 500 | D | FPI | A2 |
| 68 | 506 | G | EIF | A2 |
| 69 | 518 | E | DGP | A2 |
| 70 | 556 | K | ESV | A2 |
| 71 | 565 | Q | IMS | A2 |
| 72 | 566 | I | MSD | A2 |
| 73 | 598 | P | AGV | A2 |
| 74 | 599 | A | GVQ | A2 |
| 75 | 603 | L | EDP | A2 |
| 76 | 616 | S | ING | A2 |

TABLE 5-continued

Insertion locations for XTEN linked to the FVIII BDD sequence

| No. | XTEN Insertion Point | Insertion Residue | FVIII BDD Downstream Sequence | FVIII Domain |
|---|---|---|---|---|
| 77 | 686 | G | LWI | A2 |
| 78 | 713 | K | NTG | A2 |
| 79 | 719 | Y | EDS | A2 |
| 80 | 730 | L | LSK | A2 |
| 81 | 733 | K | NNA | A2 |
| 82 | 745 | N | PPV | B |
| 83 | 1640 | P | PVL | B |
| 84 | 1652 | R | TTL | B |
| 85 | 1656 | Q | SDQ | A3 |
| 86 | 1685 | N | QSP | A3 |
| 87 | 1711 | M | SSS | A3 |
| 88 | 1713 | S | SPH | A3 |
| 89 | 1720 | N | RAQ | A3 |
| 90 | 1724 | S | GSV | A3 |
| 91 | 1725 | G | SVP | A3 |
| 92 | 1726 | S | VPQ | A3 |
| 93 | 1741 | G | SFT | A3 |
| 94 | 1744 | T | QPL | A3 |
| 95 | 1749 | R | GEL | A3 |
| 96 | 1773 | V | TFR | A3 |
| 97 | 1792 | Y | EED | A3 |
| 98 | 1793 | E | EDQ | A3 |
| 99 | 1796 | Q | RQG | A3 |
| 100 | 1798 | Q | GAE | A3 |
| 101 | 1799 | G | AEP | A3 |
| 102 | 1802 | P | RKN | A3 |
| 103 | 1803 | R | KNF | A3 |
| 104 | 1807 | V | KPN | A3 |
| 105 | 1808 | K | PNE | A3 |
| 106 | 1827 | K | DEF | A3 |
| 107 | 1844 | E | KDV | A3 |
| 108 | 1861 | N | TLN | A3 |
| 109 | 1863 | L | NPA | A3 |
| 110 | 1896 | E | RNC | A3 |
| 111 | 1900 | R | APC | A3 |
| 112 | 1904 | N | IQM | A3 |
| 113 | 1905 | I | QME | A3 |
| 114 | 1910 | P | TFK | A3 |
| 115 | 1920 | A | ING | A3 |
| 116 | 1937 | D | QRI | A3 |
| 117 | 1981 | G | VFE | A3 |
| 118 | 2019 | N | KCQ | A3 |
| 119 | 2020 | K | CQT | C1 |
| 120 | 2044 | G | QWA | C1 |
| 121 | 2068 | F | SWI | C1 |
| 122 | 2073 | V | DLL | C1 |
| 123 | 2090 | R | QKF | C1 |
| 124 | 2092 | K | FSS | C1 |
| 125 | 2093 | F | SSL | C1 |
| 126 | 2111 | K | WQT | C1 |
| 127 | 2115 | Y | RGN | C1 |
| 128 | 2120 | T | GTL | C1 |
| 129 | 2125 | V | FFG | C1 |
| 130 | 2171 | L | NSC | C1 |
| 131 | 2173 | S | CSM | C2 |
| 132 | 2188 | A | QIT | C2 |
| 133 | 2223 | V | NNP | C2 |
| 134 | 2224 | N | NPK | C2 |
| 135 | 2227 | K | EWL | C2 |
| 136 | 2268 | G | HQW | C2 |
| 137 | 2277 | N | GKV | C2 |
| 138 | 2278 | G | KVK | C2 |
| 139 | 2290 | F | TPV | C2 |
| 140 | 2332 | Y | C terminus of FVIII | CT |

Indicates an insertion point for XTEN based on the amino acid number of mature full-length human FVIII, wherein the insertion could be either on the N- or C-terminal side of the indicated amino acid Downstream sequence in FVIII BDD with 746-1639 deletion

TABLE 6

Exemplary insertion locations for XTEN linked to a FVIII polypeptide

| No. | XTEN Insertion Point | Insertion Residue | FVIII BDD Downstream Sequence | FVIII Domain | Distance from insertion residue |
|---|---|---|---|---|---|
| 9 | 32 | P | RVP | A1 | −3, +6 |
| 31 | 220 | R | DAA | A1 | — |
| 34 | 224 | S | ARA | A1 | +5 |
| 43 | 336 | R | MKN | a1 | −1, +6 |
| 44 | 339 | N | NEE | a1 | −4, +5 |
| 52 | 399 | V | LAP | A2 | −6, +3 |
| 56 | 416 | P | QRI | A2 | +6 |
| 75 | 603 | L | EDP | A2 | _6, +6 |
| 85 | 1656 | Q | SDQ | B | −3, +6 |
| 87 | 1711 | M | SSS | A3 | −6, +1 |
| 91 | 1725 | G | SVP | A3 | +6 |
| 113 | 1905 | I | QME | A3 | +6 |
| 114 | 1910 | P | TFK | A3 | −5, +6 |

Distance from insertion residue refers to the relative number of amino acids away from the N-terminus (negative numbers) or C-terminus (positive numbers) of the designated insertion residue (residue "0") where an insertion may be made. The designation "−x" refers to an insertion site which is x amino acids away on the N-terminal side of the designated insertion residue. Similarly, the designation "+x" refers to an insertion site which is x amino acids away on the C-terminal side of the designated insertion residue.

For example, "−1, +2" indicates that the insertion is made at the N-terminus or C-terminus, if amino acid residues denoted −1, 0, +1 or +2.

TABLE 7

Further exemplary insertion locations for XTEN linked to a FVIII polypeptide

| No. | XTEN Insertion Point Range | First Insertion Residue | FVIII Domain |
|---|---|---|---|
| 3 | 18-32 | Q | A1 |
| 8 | 40 | F | A1 |
| 18 | 211-224 | E | A1 |
| 27 | 336-403 | R | A1, A2 |
| 43 | 599 | A | A2 |
| 47 | 745-1640 | N | B |
| 50 | 1656-1728 | Q | B, A3 |
| 57 | 1796-1804 | R | A3 |
| 65 | 1900-1912 | R | A3 |
| 81 | 2171-2332 | L | C1, C2 | indicates range of insertion sites numbered relative to the amino acid number of mature human FVIII

TABLE 8

Exemplary XTEN insertion locations within B-domain deleted variants of a FVIII polypeptide

| XTEN Insertion Point Range | First Insertion Residue | Second Insertion Residue |
|---|---|---|
| 740-1640 | R | P |
| 740-1690 | R | S |
| 741-1648 | S | R |
| 743-1638 | S | Q |
| 745-1638 | N | Q |
| 745-1640 | N | P |
| 745-1656 | N | Q |
| 745-1657 | N | S |
| 745-1667 | N | T |
| 745-1686 | N | Q |
| 747-1642 | R | V |
| 751-1667 | T | T | indicates the amino acids linked within the B-domain deleted variant and adjacent A3 domain, with the amino acids numbered relative to the amino acid number of mature human FVIII indicates the amino acids linked by an XTEN inserted in the BDD-FVIII

TABLE 9

Exemplary insertion locations for XTEN linked to a FVIII polypeptide resulting in procoagulant activity

| No. | XTEN Insertion Point | Insertion Residue | FVIII BDD Downstream Sequence | FVIII Domain |
|---|---|---|---|---|
| 2 | 3 | R | RYY | A1 |
| 4 | 18 | Q | SDL | A1 |
| 5 | 22 | G | ELP | A1 |
| 7 | 26 | V | DAR | A1 |
| 9 | 32 | P | RVP | A1 |
| 11 | 40 | F | NTS | A1 |
| 18 | 116 | D | QTS | A1 |
| 19 | 119 | S | QRE | A1 |
| 26 | 188 | K | TQT | A1 |
| 29 | 211 | E | TKN | A1 |
| 30 | 216 | L | MQD | A1 |
| 31 | 220 | R | DAA | A1 |
| 34 | 224 | S | ARA | A1 |
| 35 | 230 | K | MHT | A1 |
| 40 | 333 | P | QLR | A1 |
| 43 | 336 | R | MKN | a1 |
| 44 | 339 | N | NEE | a1 |
| 52 | 399 | V | LAP | A2 |
| 53 | 403 | D | DRS | A2 |
| 55 | 409 | S | QYL | A2 |
| 56 | 416 | P | QRI | A2 |

TABLE 9-continued

Exemplary insertion locations for XTEN linked to a FVIII polypeptide resulting in procoagulant activity

| No. | XTEN Insertion Point | FVIII Insertion Residue | BDD Downstream Sequence | FVIII Domain |
|---|---|---|---|---|
| 60 | 442 | I | QHE | A2 |
| 62 | 487 | Y | SRR | A2 |
| 63 | 490 | R | LPK | A2 |
| 66 | 494 | G | VKH | A2 |
| 69 | 518 | E | DGP | A2 |
| 74 | 599 | A | GVQ | A2 |
| 75 | 603 | L | EDP | A2 |
| 78 | 713 | K | NTG | A2 |
| 82 | 745 | N | PPV | B |
| 85 | 1656 | Q | SDQ | A3 |
| 87 | 1711 | M | SSS | A3 |
| 89 | 1720 | N | RAQ | A3 |
| 91 | 1725 | G | SVP | A3 |
| 99 | 1796 | Q | RQG | A3 |
| 102 | 1802 | P | RKN | A3 |
| 110 | 1896 | E | RNC | A3 |
| 111 | 1900 | R | APC | A3 |
| 112 | 1904 | N | IQM | A3 |
| 113 | 1905 | I | QME | A3 |
| 114 | 1910 | P | TFK | A3 |
| 121 | 2068 | F | SWI | C1 |
| 130 | 2171 | L | NSC | C1 |
| 135 | 2227 | K | EWL | C2 |
| 137 | 2277 | N | GKV | C2 |
| 140 | 2332 | Y | C terminus of FVIII | C2 |

Downstream sequence in FVIII BDD with 746-1639 deletion

Figure 11:
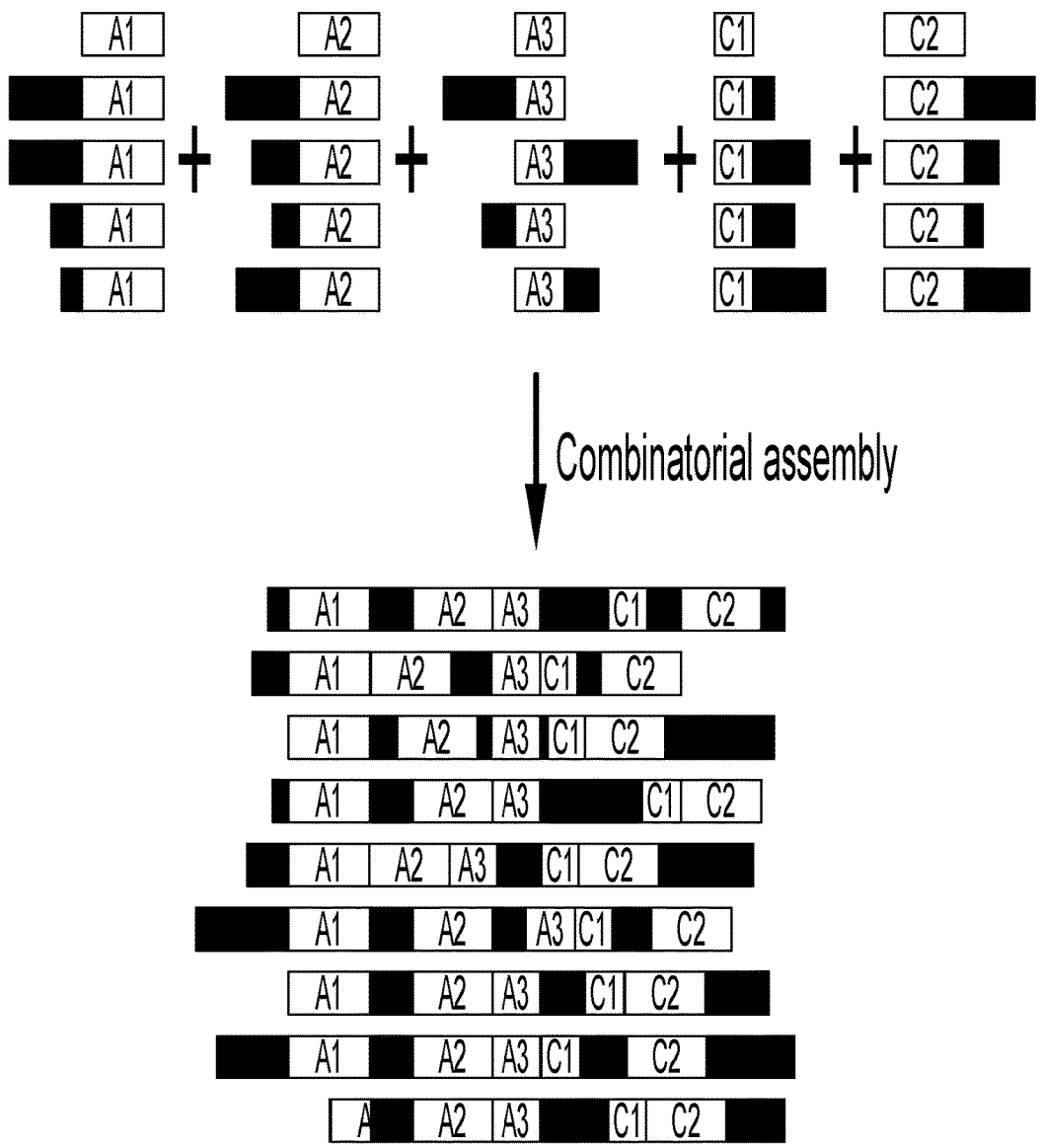
Figure 15:
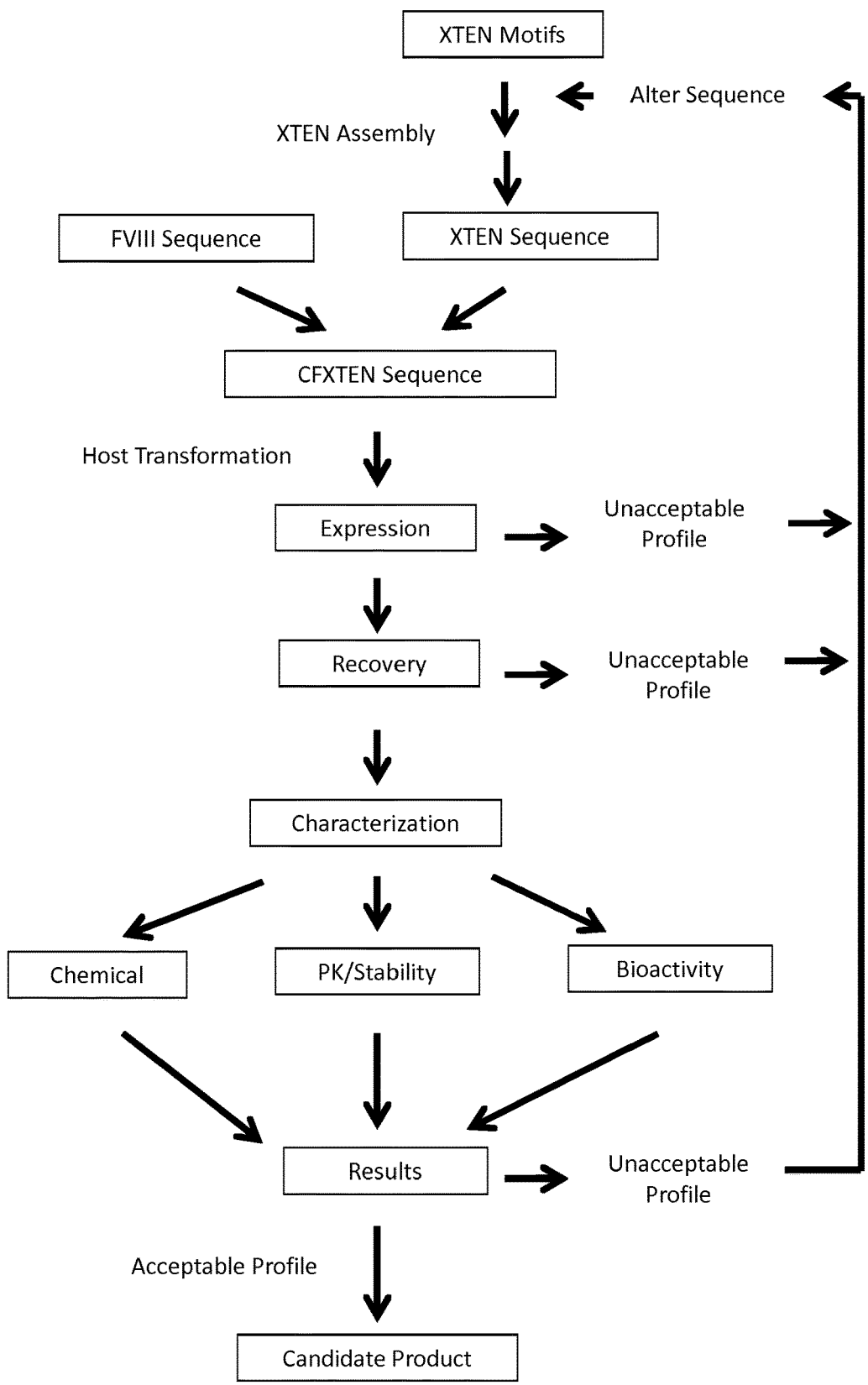
FIG. 15 is a schematic flowchart of representative steps in the assembly of a gene encoding fusion protein comprising a CF and XTEN, its expression and recovery as a fusion protein, and its evaluation as a candidate CFXTEN product.

In another aspect, the invention provides libraries of components and methods to create the libraries derived from nucleotides encoding FVIII segments, XTEN, and FVIII segments linked to XTEN that are useful in the preparation of genes encoding the subject CFXTEN. In a first step, a library of genes encoding FVIII and XTEN inserted into the various single sites at or within 1-6 amino acids of an insertion site identified in Table 5 or illustrated in FIGS. 8-9 are created, expressed, and the CFXTEN recovered and evaluated for activity and pharmacokinetics as illustrated in FIG. 15. Those CFXTEN showing enhanced properties are then used to create genes encoding a FVIII segment and the insertion site plus an XTEN, with components from each enhanced insertion represented in the library, as illustrated in FIG. 11. In one embodiment, the library components are assembled using standard recombinant techniques in combinatorial fashion, as illustrated in FIG. 11, resulting in permutations of CFXTEN with multiple internal and N- and C-terminus XTEN, that can include the insertion sites of or proximal to those Table 5, Table 6, Table 7, Table 8 and Table 9, or as illustrated in FIGS. 8-9. The resulting constructs would then be evaluated for activity and enhanced pharmacokinetics, and those candidates resulting in CFXTEN with enhanced properties, e.g., reduced active clearance, resistance to proteases, reduced immunogenicity, and enhance pharmacokinetics, compared to FVIII not linked to XTEN, are evaluated further.

3. XTEN Permissive Loops

As described in detail elsewhere herein and as illustrated in FIGS. 33-36, the inventors have recognized that each FVIII "A" domain comprise at least two "XTEN permissive loops" into which XTEN sequences can be inserted without eliminating procoagulant activity of the recombinant protein, or the ability of the recombinant proteins to be expressed in vivo or in vitro in a host cell. The inventors have identified the XTEN permissive loops as regions with, among other attributes, high surface or solvent exposure and high conformational flexibility. The A1 domain comprises an XTEN permissive loop-1 (A1-1) region and an XTEN permissive loop-2 (A1-2) region, the A2 domain comprises an XTEN permissive loop-1 (A2-1) region and an XTEN permissive loop-2 (A2-2) region, the A3 domain comprises an XTEN permissive loop-1 (A3-1) region and an XTEN permissive loop-2 (A3-2) region.

In certain aspects a recombinant FVIII protein as described above comprises at least one XTEN sequence inserted into at least one of the XTEN permissive loops A1-1, A1-2, A2-1, A2-2, A3-1, or A3-2, wherein the recombinant FVIII protein has procoagulant activity and can be expressed in vivo or in vitro in a host cell. In certain aspects a recombinant FVIII protein as described above comprises at least two XTEN sequences inserted into FVIII, e.g., into two different XTEN permissive loops A1-1, A1-2, A2-1, A2-2, A3-1, or A3-2, wherein the recombinant FVIII protein has procoagulant activity and can be expressed in vivo or in vitro in a host cell. Alternatively, a recombinant FVIII protein as described above can comprise two or more XTEN sequences inserted into a single XTEN permissive loop either with our without XTEN sequences inserted into other XTEN permissive loops, wherein the recombinant FVIII protein has procoagulant activity and can be expressed in vivo or in vitro in a host cell. In certain aspects a recombinant FVIII protein as described above can comprise at least one XTEN sequence inserted into at least one of the XTEN permissive loops as described above, and can further comprise one or more XTEN sequences inserted into a3, wherein the recombinant FVIII protein has procoagulant activity and can be expressed in vivo or in vitro in a host cell. In certain aspects, a recombinant FVIII protein of the invention can comprise three, four, five, six or more XTEN sequences inserted into one or more XTEN permissive loops or into a3, wherein the recombinant FVIII protein has procoagulant activity and can be expressed in vivo or in vitro in a host cell.

In certain aspects a recombinant FVIII protein as described above comprises at least one XTEN sequence inserted into a3, wherein the recombinant FVIII protein has procoagulant activity and can be expressed in vivo or in vitro in a host cell. In certain aspects a recombinant FVIII protein of the invention comprises at least one XTEN sequence inserted into a3, and further comprises one or more XTEN sequences inserted into one or more XTEN permissive loops as described above, wherein the recombinant FVIII protein has procoagulant activity and can be expressed in vivo or in vitro in a host cell.

The inventors have recognized that a recombinant FVIII protein of the invention comprises at least two XTEN permissive loops in each of the FVIII A domain regions which allows for insertion of an XTEN sequence while having procoagulant activity and still being able to be expressed in vivo or in vitro by a host cell. Various crystal structures of FVIII have been determined, of varying degrees of resolution. These structures of FVIII and FVIIIa, determined by X-ray crystallography and molecular dynamic simulation, were used to generate models of accessible surface area and conformational flexibility for FVIII. For example, the crystal structure of human FVIII has been determined by Shen et al. Blood 111: 1240-1247 (2008) and Ngo et al. Structure 16: 597-606 (2008). The data for these structures is available from the Protein Data Bank (pdb.org) under Accession Numbers 2R7E and 3CDZ, respectively.

The predicted secondary structure of the heavy and light chains of human FVIII according to the Shen et al. crystal structure is reproduced in FIGS. 37A and 37B. The various beta strands predicted from the Shen et al. crystal structure are numbered consecutively in FIGS. 8A and 8B. In certain embodiments, the XTEN permissive loops A1-1, A1-2, A2-1, A2-2, A3-1, and A3-2 are contained within surface-exposed, flexible loop structures in the A domains of FVIII. A1-1 is located between beta strand 1 and beta strand 2, A1-2 is located between beta strand 11 and beta strand 12, A2-1 is located between beta strand 22 and beta strand 23, A2-2 is located between beta strand 32 and beta strand 33, A3-1 is located between beta strand 38 and beta strand 39 and A3-2 is located between beta strand 45 and beta strand 46, according to the secondary structure of mature FVIII stored as Accession Number 2R7E of the PDB database (PDB:2R7E) and as shown in FIGS. 8A and 8B. The secondary structure of PDB Accession Number 2R7E shown in FIGS. 8A and 8B corresponds to the standardized secondary structure assignment according to the DSSP program (Kabsch and Sander, Biopolymers, 22:2577-2637 (1983)). The DSSP secondary structure of the mature FVIII stored as PDB Accession Number 2R7E can be accessed at the DSSP database, available at the world wide web site swift.cmbi.ru.nl/gv/dssp/ (last accessed Feb. 9, 2012) (Joosten et al., 39 (Suppl. 1): D411-D419 (2010)).

Figure 30A:
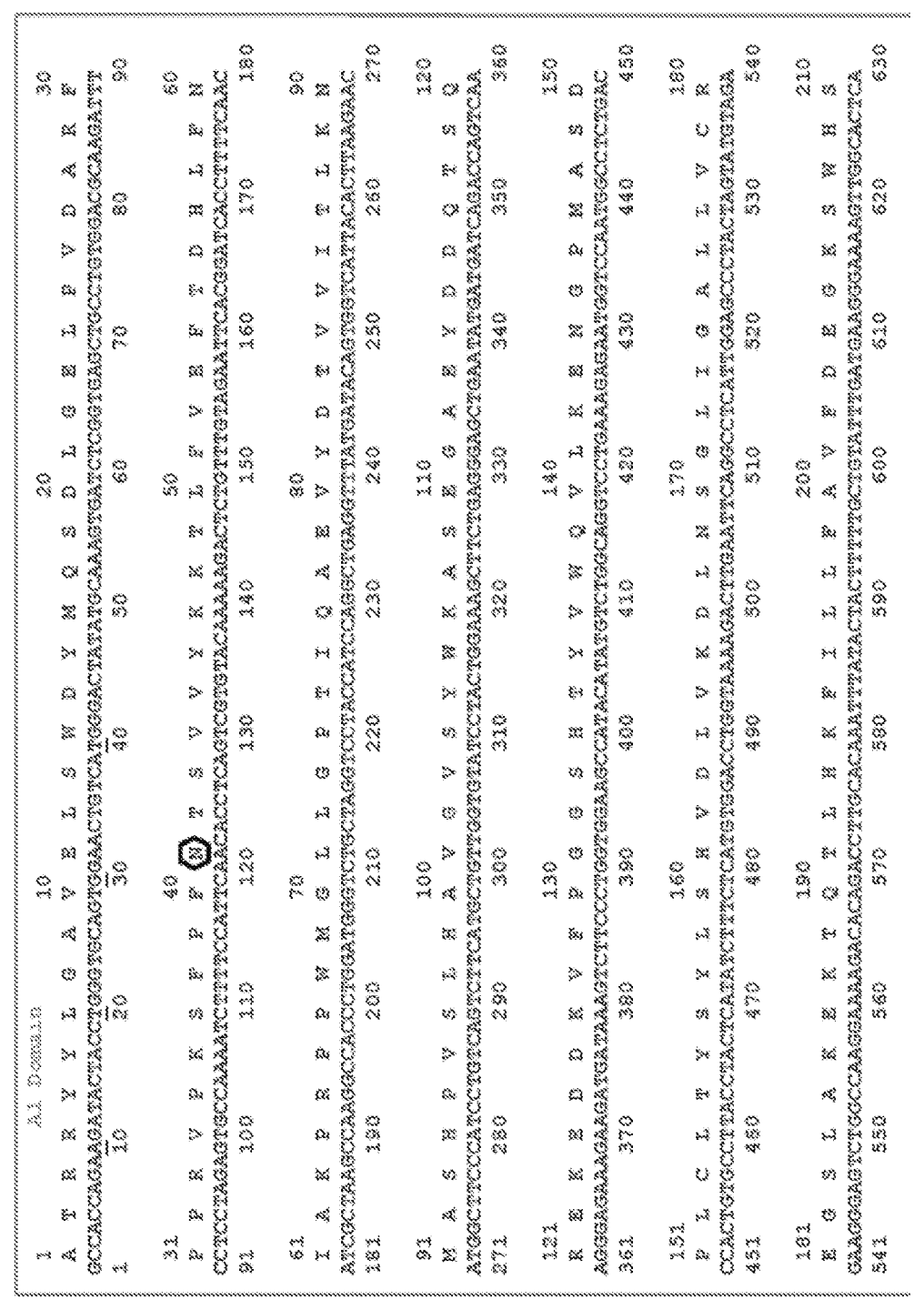
Figure 30B:
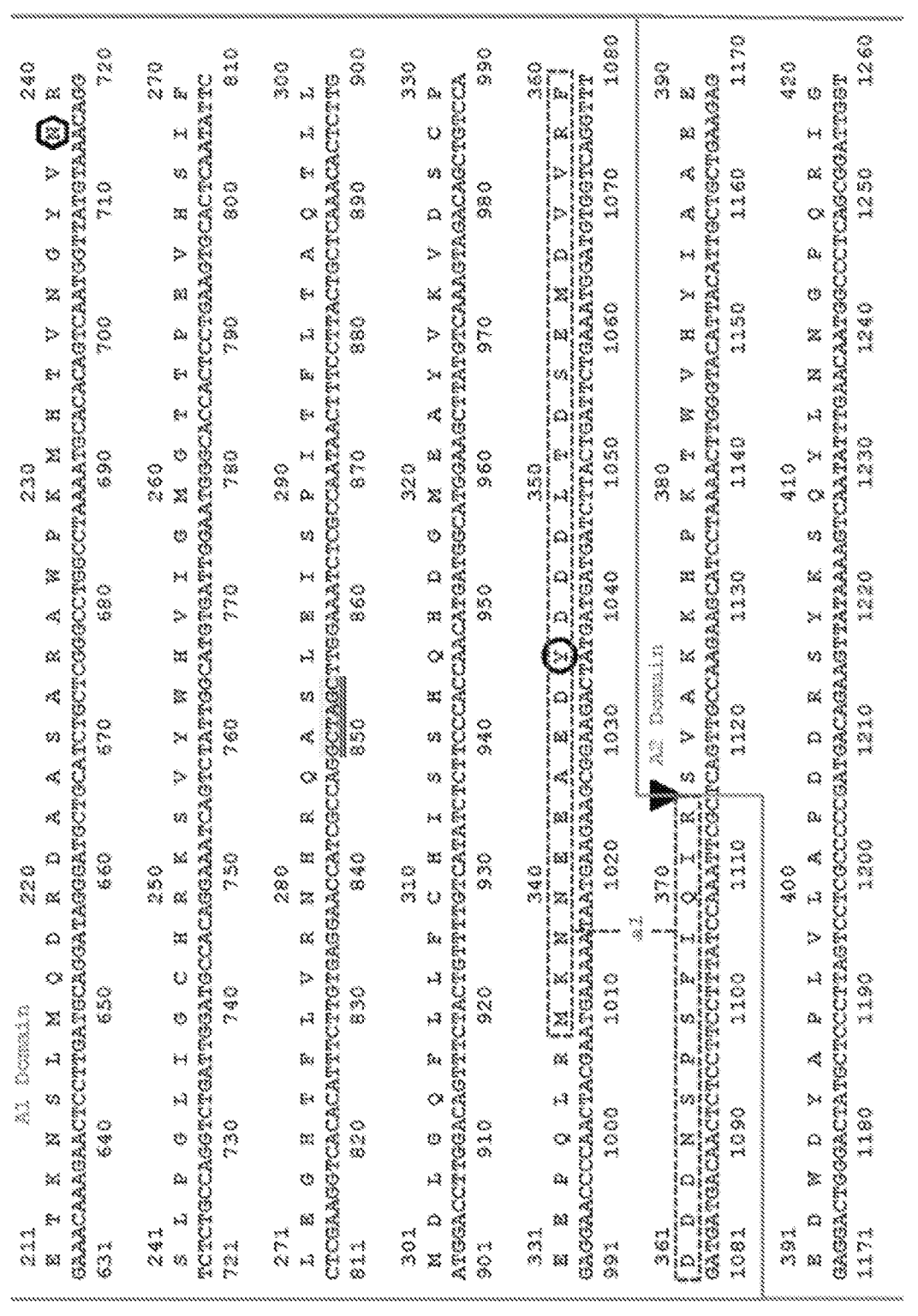
Figure 30C:
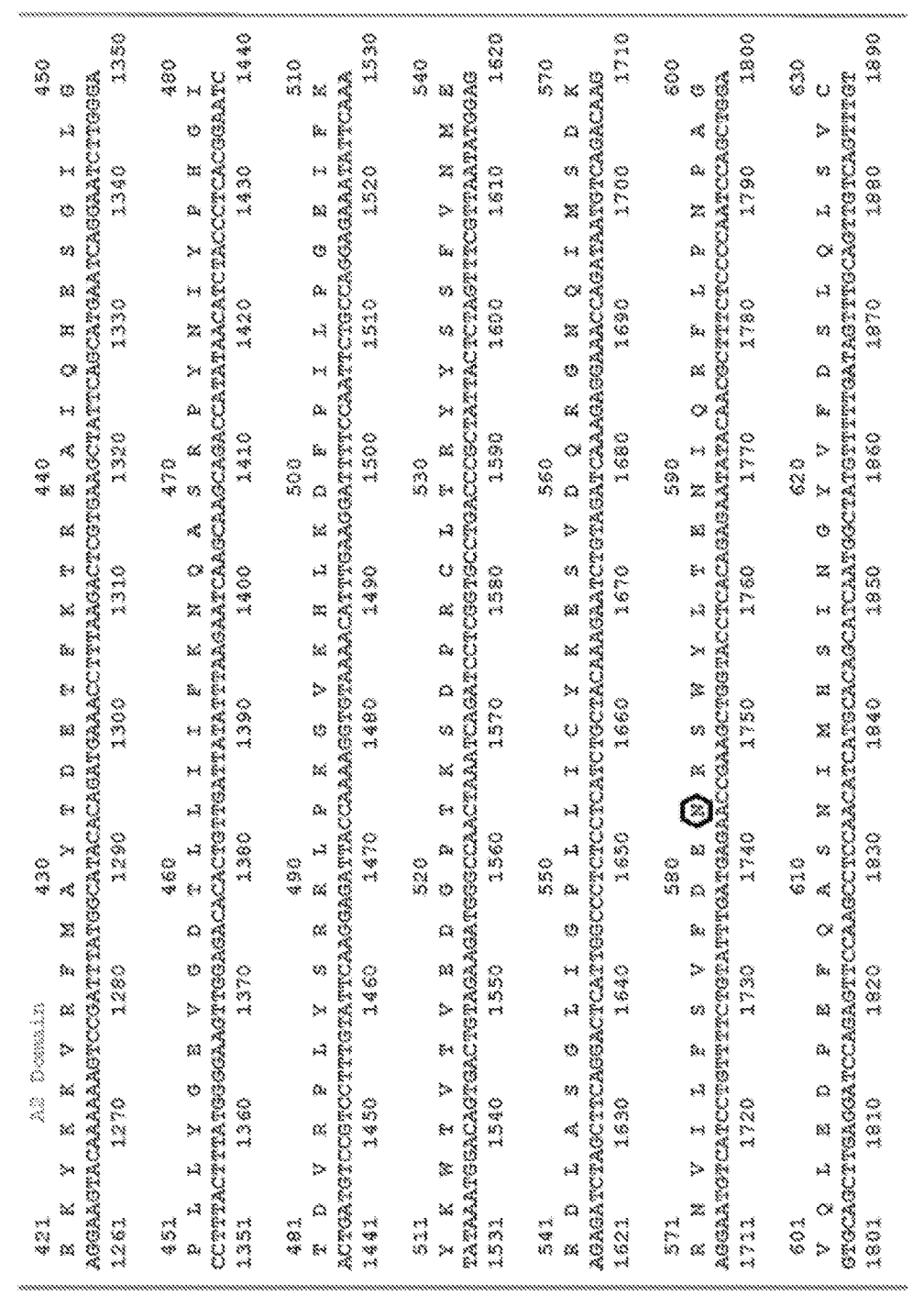
Figure 30D:
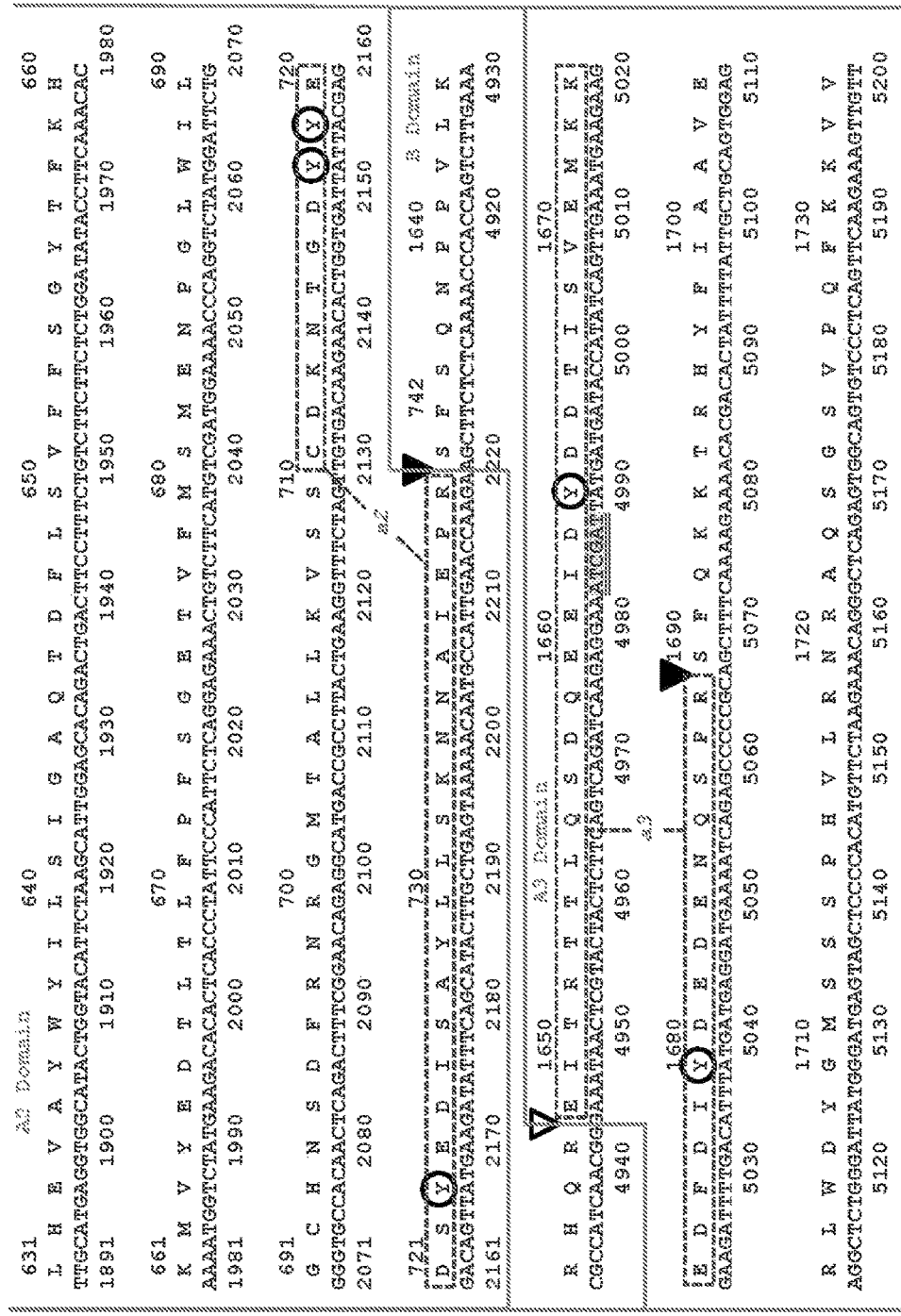
FIG. 30 depicts the primary sequence and domain structure of mature B-domain deleted (BDD) human FVIII construct (Example 46). The location of the introduced NheI and ClaI restriction sites is shown. Note that the amino acid numbering corresponds to the amino acid positions in the primary sequence of mature FVIII (FIG. 30). Individual domains are bounded by gray lines/boxes with domain identification in gray text. Acidic regions (a1, a2, a3) are indicated with dashed boxes. Solid wedges/triangles indicate sites of thrombin cleavage in the activation of FVIII to FVIIIa. Unfilled wedges/triangle indicates the site of intracellular proteolytic processing to the two-chained form of FVIII. Hexagons indicate sites of N-linked glycosylation. Circles indicate sites of Tyr sulfation. Unique non-native restriction sites (NheI, GCTAG; ClaI, ATCGAT) introduced into cDNA to facilitate XTEN insertion/recombination are highlighted in gray with double underline.
Figure 30E:
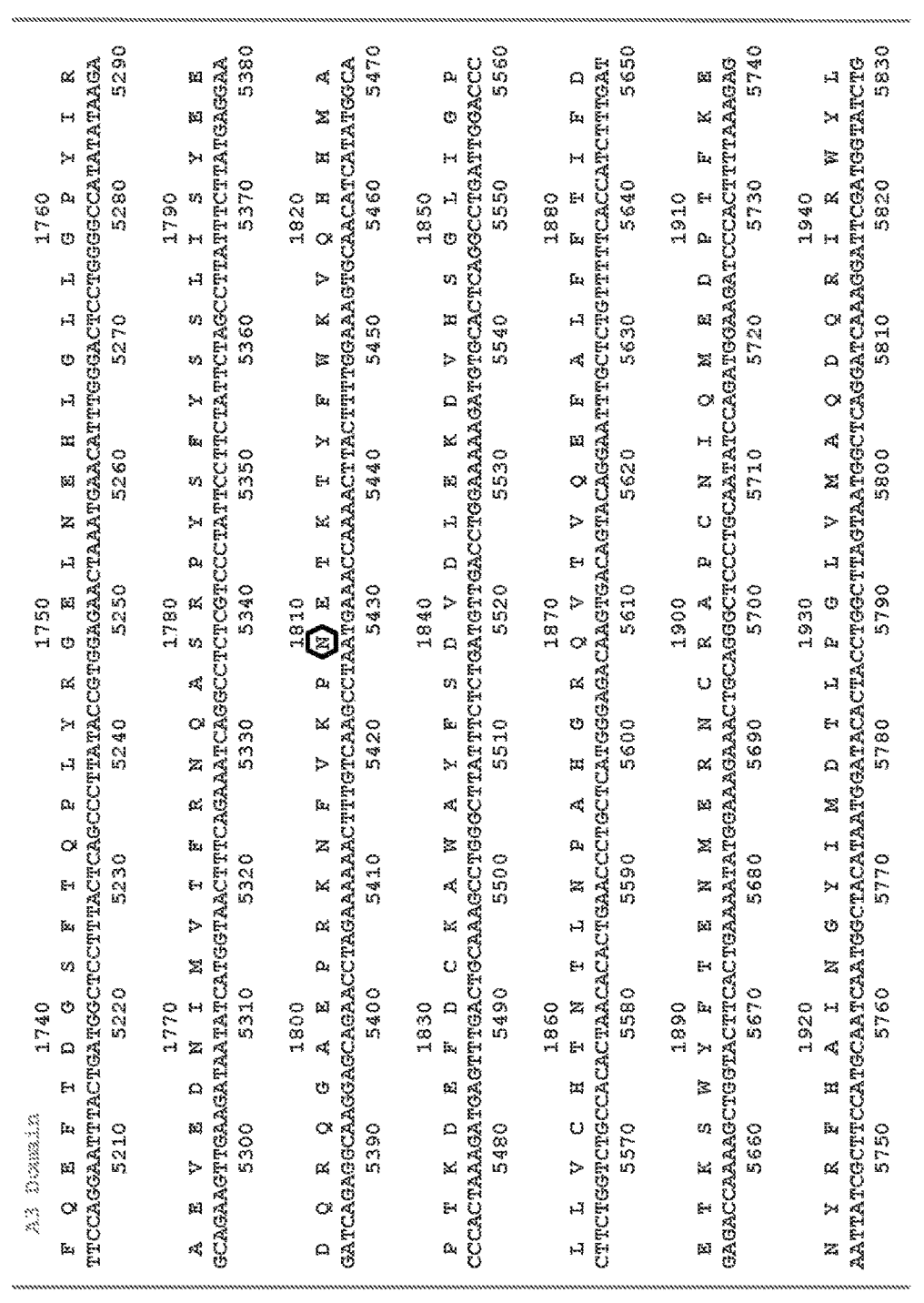
Figure 30F:
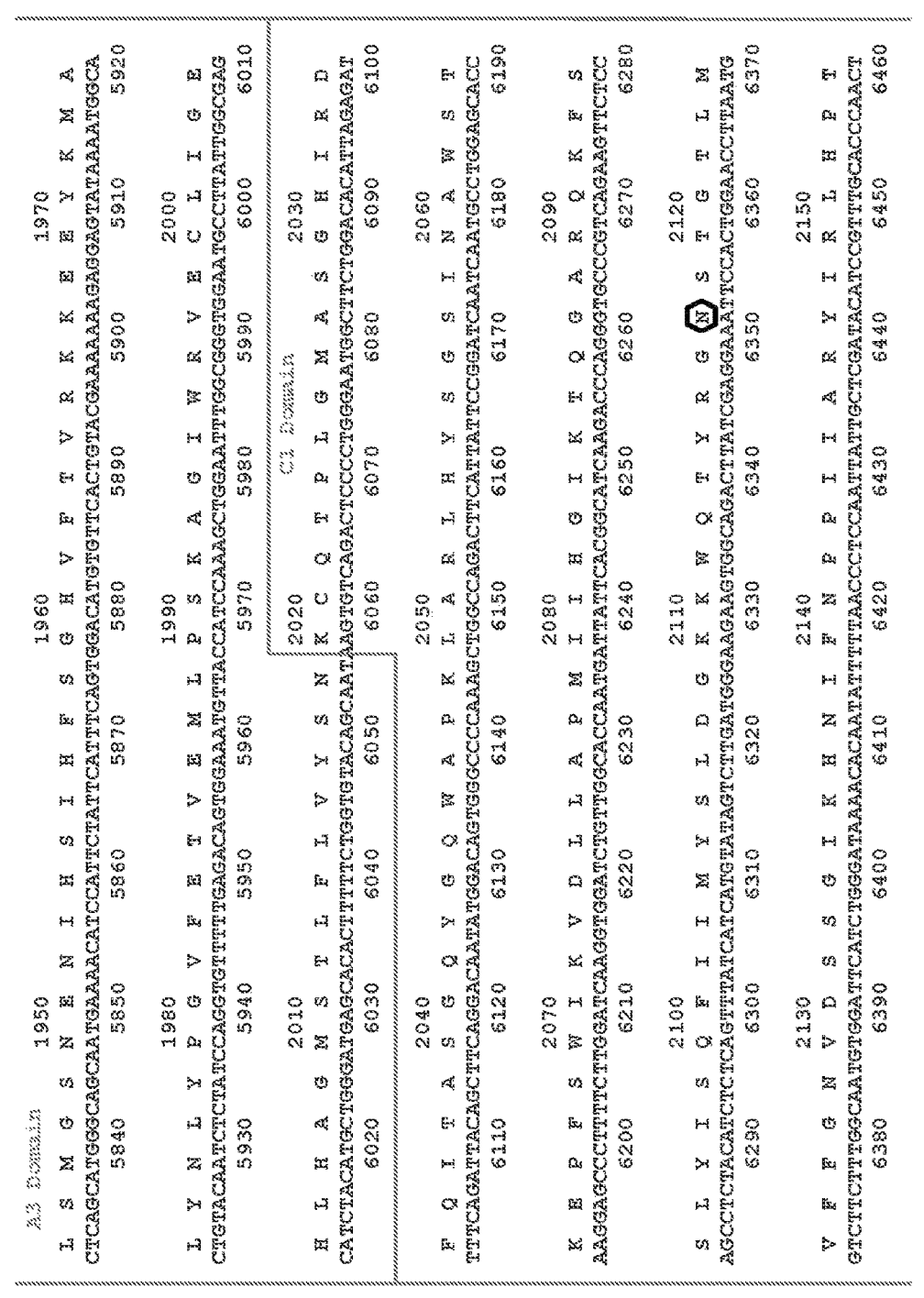
Figure 30G:
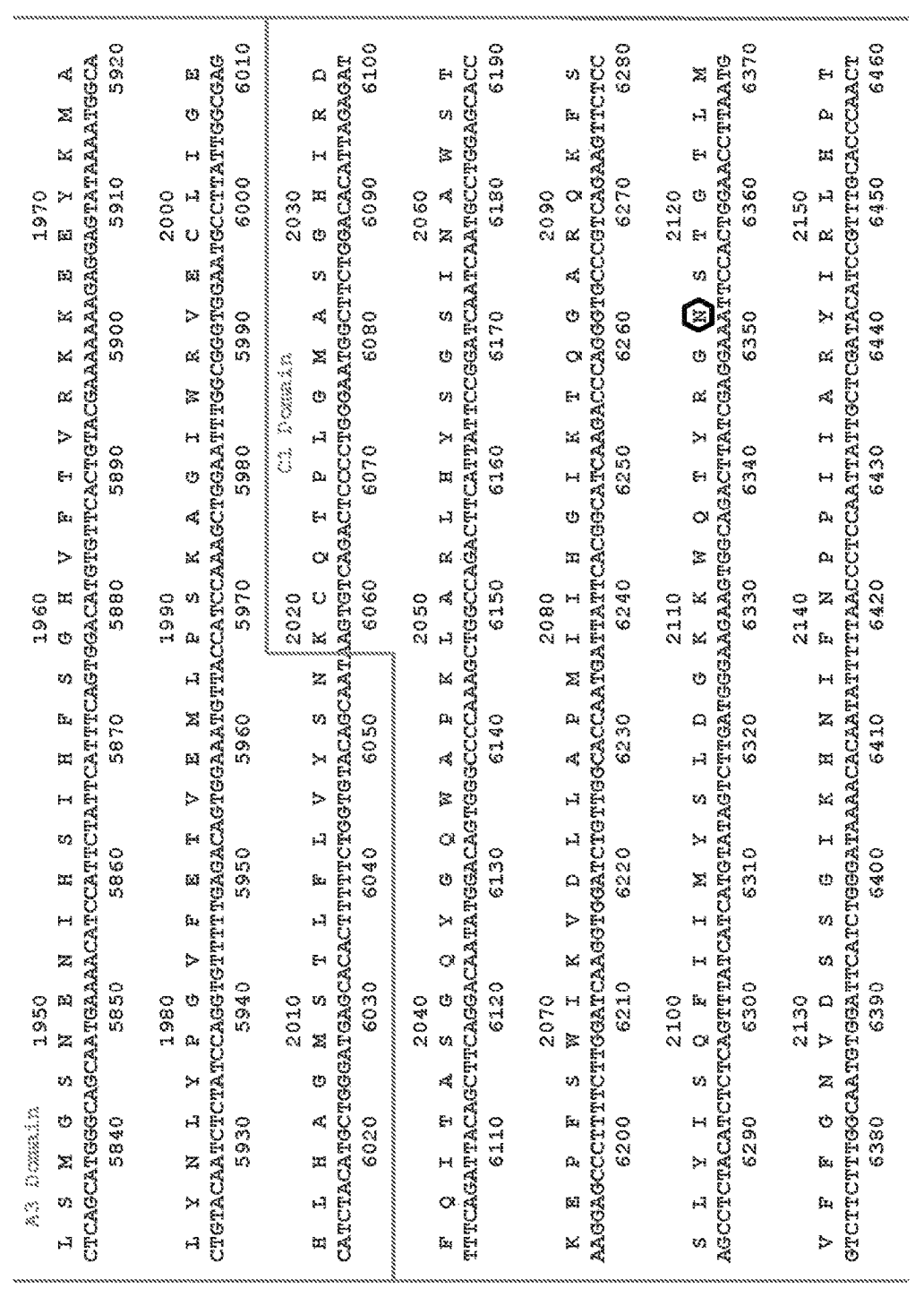
Figure 30H:
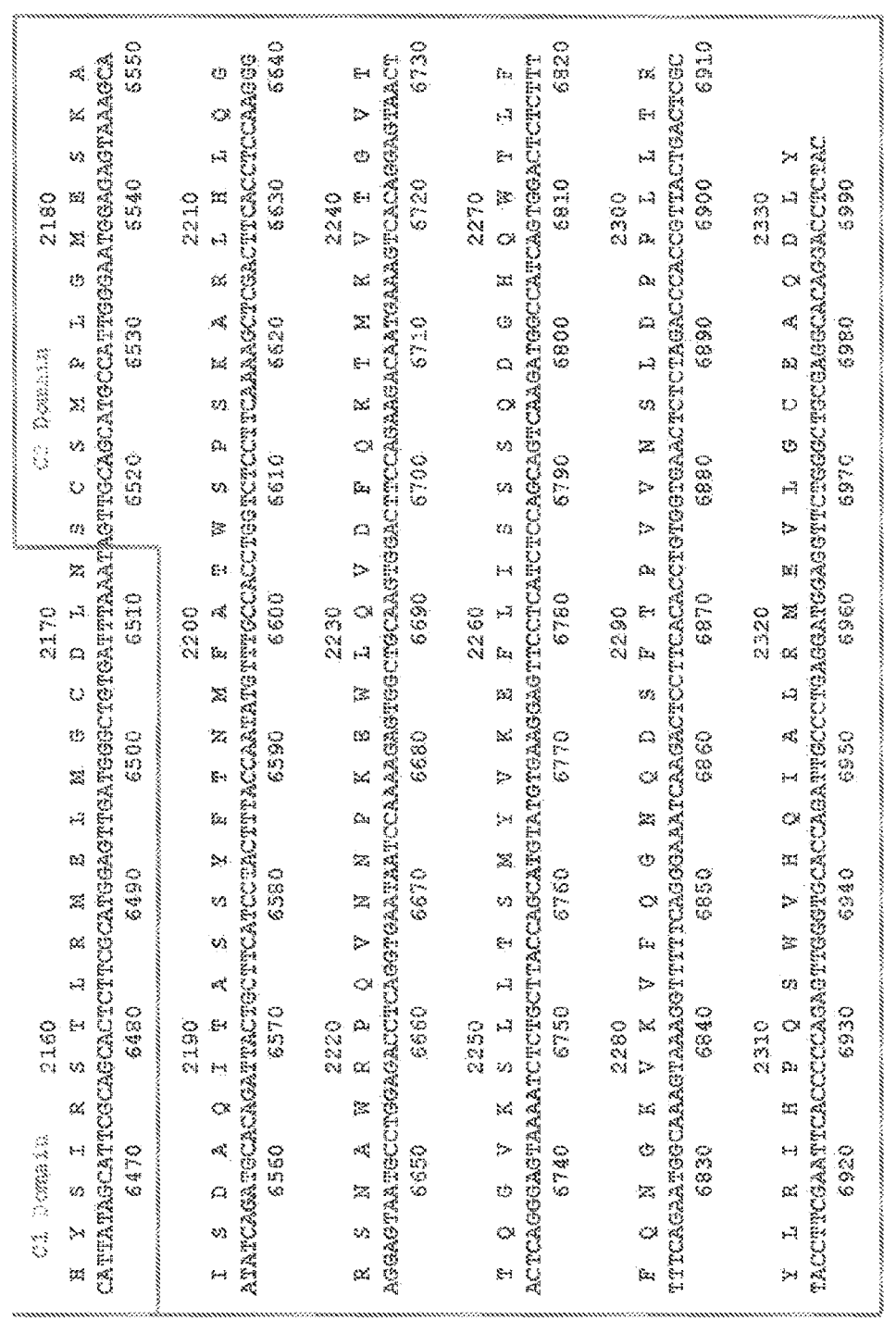
Figure 31:
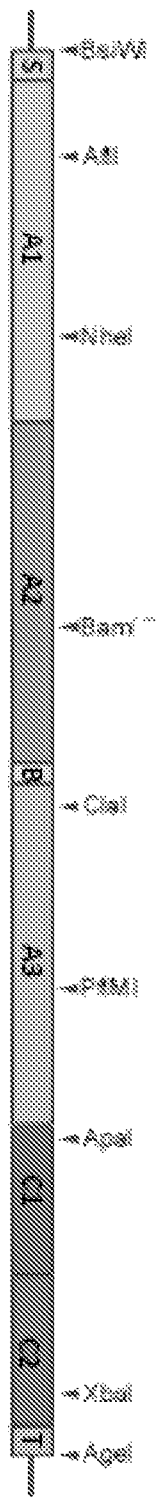
FIG. 31 provides graphical representation of the FVIII construct described in FIG. 30, indicating the domain organization and the location of native and non-native restriction sites.

In certain aspects, a surface-exposed, flexible loop structure comprising A1-1 corresponds to a region in native mature human FVIII from about amino acid 15 to about amino acid 45 of FIG. 30. In certain aspects, A1-1 corresponds to a region in native mature human FVIII from about amino acid 18 to about amino acid 41 of FIG. 30. In certain aspects, the surface-exposed, flexible loop structure comprising A1-2 corresponds to a region in native mature human FVIII from about amino acid 201 to about amino acid 232 of FIG. 30. In certain aspects, A1-2 corresponds to a region in native mature human FVIII from about amino acid 218 to about amino acid 229 of FIG. 30. In certain aspects, the surface-exposed, flexible loop structure comprising A2-1 corresponds to a region in native mature human FVIII from about amino acid 395 to about amino acid 421 of FIG. 30. In certain aspects, A2-1 corresponds to a region in native mature human FVIII from about amino acid 397 to about amino acid 418 of FIG. 30. In certain aspects, the surface-exposed, flexible loop structure comprising A2-2 corresponds to a region in native mature human FVIII from about amino acid 577 to about amino acid 635 of FIG. 30. In certain aspects, A2-2 corresponds to a region in native mature human FVIII from about amino acid 595 to about amino acid 607 of FIG. 30. In certain aspects, the surface-exposed, flexible loop structure comprising A3-1 corresponds to a region in native mature human FVIII from about amino acid 1705 to about amino acid 1732 of FIG. 30. In certain aspects, A3-1 corresponds to a region in native mature human FVIII from about amino acid 1711 to about amino acid 1725 of FIG. 30. In certain aspects, the surface-exposed, flexible loop structure comprising A3-2 corresponds to a region in native mature human FVIII from about amino acid 1884 to about amino acid 1917 of FIG. 3. In certain aspects, A3-2 corresponds to a region in native mature human FVIII from about amino acid 1899 to about amino acid 1911 of FIG. 30.

In certain aspects a recombinant FVIII protein of the invention comprises one or more XTEN sequences inserted into one or more XTEN permissive loops of FVIII, or into the a3 region, wherein the recombinant FVIII protein has procoagulant activity and can be expressed in vivo or in vitro in a host cell. XTEN sequences to be inserted include those that increase the in vivo half-life or the in vivo or in vitro stability of FVIII.

In certain aspects, a recombinant FVIII protein of the invention comprises an XTEN sequences inserted immediately downstream of one or more amino acids corresponding to one or more amino acids in mature native human FVIII including, but not limited to: amino acid 18 of FIG. 30, amino acid 26 of FIG. 30, amino acid 40 of FIG. 30, amino acid 220 of FIG. 30, amino acid 224 of FIG. 30, amino acid 399 of FIG. 30, amino acid 403 of FIG. 30, amino acid 599 of FIG. 30, amino acid 603 of FIG. 30, amino acid 1711 of FIG. 30, amino acid 1720 of FIG. 30, amino acid 1725 of FIG. 30, amino acid 1900 of FIG. 30, amino acid 1905 of FIG. 30, amino acid 1910 of FIG. 30, or any combination thereof, including corresponding insertions in BDD-variants of FVIII described herein.

In certain aspects, a recombinant FVIII protein of the invention comprises at least one XTEN sequence inserted into the a3 region of FVIII, either alone or in combination with one or more XTEN sequences being inserted into the XTEN permissive loops of the A domains (e.g., A1-1, A1-2, A2-1, A2-2, A3-1, or A3-2 as described above), wherein the recombinant FVIII protein has procoagulant activity and can be expressed in vivo or in vitro in a host cell. In certain aspects, at least one XTEN sequence is inserted into the a3 region immediately downstream of an amino acid which corresponds to amino acid 1656 of FIG. 30. In certain aspects, a recombinant FVIII protein of the invention comprises an XTEN sequence inserted into the a3 region as described, and further includes one or more XTEN sequences inserted immediately downstream of one or more amino acids corresponding to one or more amino acids in mature native human FVIII including, but not limited to: amino acid 18 of FIG. 30, amino acid 26 of FIG. 30, amino acid 40 of FIG. 30, amino acid 220 of FIG. 30, amino acid 224 of FIG. 30, amino acid 399 of FIG. 30, amino acid 403 of FIG. 30, amino acid 599 of FIG. 30, amino acid 603 of FIG. 30, amino acid 1711 of FIG. 30, amino acid 1720 of FIG. 30, amino acid 1725 of FIG. 30, amino acid 1900 of FIG. 30, amino acid 1905 of FIG. 30, amino acid 1910 of FIG. 30, or any combination thereof.

It will be understood by one of skill in the art that the foregoing aspects of permissive loops of a native FVIII protein into which a heterologous protein can be inserted are also applicable to the B-domain deleted FVIII variants described herein; e.g., sequences set forth in Table 1. In practicing the present invention, it will be understood that a BDD-FVIII sequence of Table 1 can be substituted for the recombinant FVIII protein of the various embodiments described above, and it is believed that the resulting constructs will similarly retain procoagulant activity.

4. Interference with FVIII Binding Agents

It is an object of the present invention to provide procoagulant CFXTEN fusion protein compositions for use in human patients suffering from coagulopathies, such as haemophilia A, who have native or acquired antibodies, inhibitors, or other proteins or molecules that bind to FVIII that affect the activity or half-life of CFXTEN fusion proteins, wherein the CFXTEN retain a greater amount of procoagulant activity compared to the corresponding FVIII not linked to XTEN. As used herein, "FVIII binding agent" means any molecule capable of binding to native FVIII or to a recombinant factor VIII fusion protein of the invention comprising factor VIII or a fragment thereof, whether native, derived, or produced recombinantly. It is specifically contemplated that FVIII binding agent includes anti-FVIII antibodies and FVIII inhibitors, amongst other proteins capable of specifically binding to FVIII. In one aspect, the invention provides procoagulant CFXTEN fusion proteins that exhibit reduced binding to an anti-FVIII antibody or FVIII inhibitor that interferes with the procoagulant activity of FVIII. As used herein, "anti-FVIII antibody" or "anti-factor VIII antibody" means an antibody capable of binding FVIII or a FVIII component of a CFXTEN of the invention, said antibody including but not limited to the antibodies of Table 10 or polyclonal antibody from a hemophilia A patient with FVIII inhibitors. The term antibody includes monoclonal antibodies, polyclonal antibodies, antibody fragments and antibody fragment clones. As used herein, "FVIII inhibitor" or "anti-FVIII inhibitor antibody" means an antibody capable of binding FVIII or a FVIII component of a CFXTEN of the invention and that reduces by any means the procoagulant activity of FVIII or the FVIII component of a CFXTEN. In another aspect, the invention provides CFXTEN fusion proteins that retain procoagulant activity in the presence of a FVIII inhibitor. In another aspect, the invention provides CFXTEN fusion proteins comprising FVIII that exhibit increased terminal half-life in the presence of a FVIII binding agent compared to the FVIII not linked to XTEN.

The majority of inhibitory antibodies to human factor VIII act by binding to epitopes located in the A2 domain or the C2 domain of factor VIII, disrupting specific functions associated with these domains, (U.S. Pat. No. 6,770,744; Fulcher et al. Localization of human factor FVIII inhibitor epitopes to two polypeptide fragments. Proc. Natl. Acad. Sci. USA (1985) 82:7728-7732; Scandella et al. Epitope mapping of human factor VIII inhibitor antibodies by deletion analysis of fVIII fragments expressed in *Escherichia coli*. Proc. Natl. Acad. Sci. USA (1988) 85:6152-6156). While 68% percent of inhibitory antibodies are reported to be directed against the A2 and/or C2 domain, 3% act against the A1 domain and 46% against the a3 acidic region (Lavigne-Lissalde, G., et al. Characteristics, mechanisms of action, and epitope mapping of anti-factor VIII antibodies. Clin Rev Allergy Immunol (2009) 37:67-79). For example, certain heavy chain-specific inhibitors react with the 18.3-kD amino-terminal segment of the A2 domain (Scandella D, et al. 1988); Lollar P et al. Inhibition of human factor VIIIa by anti-A2 subunit antibodies. J Clin Invest 1994; 93:2497). FVIII contains a phospholipid binding site in the C2 domain between amino acids 2302 and 2332, and there is also a von Willebrand factor binding site in the C2 domain that acts in conjunction with amino acids 1649-1689 in the A3 domain. The C2 domain also has epitopes that, when bound by inhibitors, block the activation of FVIII by thrombin or factor Xa. Inhibitors binding specifically to the light chain recognize epitopes in the A3 domain or a major antigenic region in the C2 domain and can result in reduced procoagulant activity by preventing the binding of FVIII to phospholipid or reducing the dissociation rate of FVIII from von Willebrand factor (Gilles J G, et al. Anti-factor VIII antibodies of hemophiliac patients are frequently directed towards nonfunctional determinants and do not exhibit isotypic restriction. Blood (1993) 82:2452; Shima M, et al. A factor VIII neutralizing monoclonal antibody and a human inhibitor alloantibody recognizing epitopes in the C2 domain inhibit factor VIII binding to von Willebrand factor and to phosphatidylserine. Thromb Haemost (1993) 69:240). Non-limiting examples of monoclonal FVIII inhibitors are listed in Table 9. In patients with high-titer inhibitors, there is an increased risk of developing recurrent bleeding in particular joints, which may ultimately result in decreased quality of life, disability, or death from excessive blood loss (U.S. Pat. Application No. 20120065077; Zhang et al., Clinic. Rev. Allerg. Immunol., 37:114-124 (2009); Gouw and van den Berg, Semin. Thromb. Hemost., 35:723-734 (2009))

While not intending to be bound by any particular theory, it is believed that the unstructured characteristic of the XTEN incorporated into the CFXTEN fusion proteins permits the XTEN to adopt conformations that result in steric hindrance to inhibitors that would otherwise bind to FVIII epitopes. As illustrated in FIG. 6, as the incorporated XTEN assumes various random coil conformations, it spatially covers regions of the FVIII component of the fusion protein and sterically interferes with the ability of an inhibitor to bind to a FVIII epitope.

In one embodiment, the invention provides CFXTEN exhibiting procoagulant activity and reduced binding in the presence of an antibody binding to the C2 domain of factor VIII compared to the corresponding factor VIII not linked to XTEN and/or to native FVIII. In another embodiment, the invention provides CFXTEN exhibiting procoagulant activity and reduced binding in the presence of an antibody binding to the A2 domain of Factor VIII compared to the corresponding factor VIII not linked to XTEN or to native FVIII. In another embodiment, the invention provides CFXTEN exhibiting procoagulant activity and reduced binding in the presence of antibodies binding to the A2 and the C2 domain of Factor VIII, compared to the corresponding factor VIII not linked to XTEN or to native FVIII.

In one embodiment, the invention provides CFXTEN exhibiting procoagulant activity and reduced binding, compared to the corresponding FVIII not linked to XTEN, in the presence of an antibody selected from the group consisting of the antibodies of Table 10. In one embodiment, the CFXTEN fusion protein exhibits reduced binding to the antibody GMA8021. In another embodiment, the CFXTEN fusion protein exhibits reduced binding to the antibody GMA8008. In another embodiment, the CFXTEN fusion protein exhibits reduced binding to the antibody ESH4. In another embodiment, the CFXTEN fusion protein exhibits reduced binding to the antibody ESH8. In another embodiment, the CFXTEN fusion protein exhibits reduced binding to the antibody B02C11. In another embodiment, the CFXTEN fusion protein exhibits reduced binding and a greater degree of procoagulant activity, compared to the corresponding FVIII not linked to XTEN, in the presence of plasma from a hemophilia A subject with polyclonal antibody FVIII inhibitors, wherein the greater degree of procoagulant activity is determined by an in vitro assay such as a Bethesda assay or other assay described herein.

The CFXTEN exhibiting reduced binding by FVIII inhibitors can have one, or two, or three, or four, or five, or six or more individual XTEN, embodiments of which are disclosed herein. In the foregoing embodiments of this paragraph, a CFXTEN exhibits at least 5%, or 10%, or 15%, or 20%, or 30%, or 40%, or 50%, or 60%, or 70% or less binding to the antibody when assessed in vitro in an assay capable of assaying the binding of an antibody to FVIII, such as assays described herein below or those known in the art. Alternatively, the reduced binding of the subject CFXTEN to the FVIII-binding antibodies can be assessed by retention of a higher degree of procoagulant activity in the presence of the antibody compared to FVIII not linked to XTEN, as described in the Examples. Thus, in the embodiments pertaining to reduced binding by FVIII inhibitors described herein, a CFXTEN exhibits, when reacted with the anti-FVIII antibody, at least 5%, or 10%, or 15%, or 20%, or 30%, or 40%, or 50%, or 60%, or 70%, or 80%, or 100%, or 200%, or 300%, or 400%, or 500% or more activity in a coagulation assay (such as described herein below) compared to the corresponding FVIII not linked to XTEN and reacted with the antibody. In the foregoing, the anti-FVIII antibody can be an antibody from Table 9 or a circulating anti-FVIII antibody from a hemophilia A subject. In another embodiment, the invention provides CFXTEN in which the assayed fusion protein, when assayed utilizing the Bethesda assay and an anti-FVIII antibody selected from Table 10 or a polyclonal anti-FVIII antibody preparation such as, but not limited to, plasma from a hemophilia A subject with FVIII inhibitors, results in a Bethesda titer with at least about 2, 4, 6, 8, 10, 12, 15, 20, 30, 40, 50, 60, 70, 80, 100, or 200 fewer Bethesda units compared to a FVIII not linked to XTEN and assayed under comparable conditions. In another embodiment, the invention provides CFXTEN in which the assayed fusion protein results in less than 50%, or less than 40%, or less than 30%, or less than 25%, or less than 20%, or less than 15%, or less than 14%, or less than 13%, or less than 12%, or less than 11%, or less than 10% of the Bethesda Units compared to a FVIII not linked to XTEN when assayed under comparable conditions utilizing the Bethesda assay and a polyclonal anti-FVIII antibody preparation such as, but not limited to, plasma from a hemophilia A subject with FVIII inhibitors.

TABLE 10

Anti-factor VIII antibodies

| Antibody Designation | Epitope | Inhibitor Titer BU/mg | Reference |
|---|---|---|---|
| BO2C11 | C2 Domain Met2199/Phe2200 | 20000 | U.S. Pat. No. 6,770,744 Blood (2007) 110: 4234-4242 |
| NMC VIII-5 | C2 Domain Glu2181-Val2243 | | U.S. Pat. No. 6,770,744 |
| ESH2 | Light Chain | | ADI |
| ESH4 | Light Chain 2303-2332 | 39 | U.S. Pat. No. 6,770,744 Blood (2007) 110: 4234-4242 |
| ESH8 | C2 Domain 2248-2285 | 10000 | U.S. Pat. No. 6,770,744 Blood (2007) 110: 4234-4242 |
| RHD5 (LMBP 6165CB) | C1 Domain | | WO 2005/016455 U.S. Pat. Application 20090263380 |
| LE2E9 | C1 Domain | | U.S. Pat. Application 20090263380 Blood (2000) 95: 156-163 |
| I54 | C2 Domain | 1300 | Blood (2007) 110: 4234-4242 |
| F85 | C2 Domain | 6 | Blood (2007) 110: 4234-4242 |
| F100 | C2 Domain | 5 | Blood (2007) 110: 4234-4242 |
| F137 | C2 Domain | 6 | Blood (2007) 110: 4234-4242 |
| I89 | C2 Domain | 1900 | Blood (2007) 110: 4234-4242 |
| I117 | C2 Domain | 1800 | Blood (2007) 110: 4234-4242 |
| I109 | C2 Domain Met2199/Phe2200 | 1500 | Blood (2007) 110: 4234-4242 |
| 1B5 | C2 Domain | 930 | Blood (2007) 110: 4234-4242 |
| 3C6 | C2 Domain | 71 | Blood (2007) 110: 4234-4242 |
| 3D12 | C2 Domain Phe2196 | 2600 | Blood (2007) 110: 4234-4242 |
| D102 | C2 Domain | 3800 | Blood (2007) 110: 4234-4242 |
| 3G6 | C2 Domain | 25000 | Blood (2007) 110: 4234-4242 |
| 2-77 | C2 Domain | 25000 | Blood (2007) 110: 4234-4242 |
| B45 | C2 Domain | 21000 | Blood (2007) 110: 4234-4242 |
| B9 | C2 Domain | 31000 | Blood (2007) 110: 4234-4242 |
| B11 | C2 Domain | 3300 | Blood (2007) 110: 4234-4242 |
| B75 | C2 Domain | Indeterminate | Blood (2007) 110: 4234-4242 |
| D105 | C2 Domain Val2223/Lys2227 | 0.8 | Blood (2007) 110: 4234-4242 |
| F77 | C2 Domain | 26000 | Blood (2007) 110: 4234-4242 |
| F178 | C2 Domain | 18000 | Blood (2007) 110: 4234-4242 |
| F67 | C2 Domain | 21000 | Blood (2007) 110: 4234-4242 |
| G99 | C2 Domain Val2223/Lys2227 | 15000 | Blood (2007) 110: 4234-4242 |
| G86 | C2 Domain | 4300 | Blood (2007) 110: 4234-4242 |
| I14 | C2 Domain | 44000 | Blood (2007) 110: 4234-4242 |

TABLE 10-continued

Anti-factor VIII antibodies

| Antibody Designation | Epitope | Inhibitor Titer BU/mg | Reference |
| --- | --- | --- | --- |
| I55 | C2 Domain | 10000 | Blood (2007) 110: 4234-4242 |
| 2-117 | C2 Domain | >0.4 | Blood (2007) 110: 4234-4242 |
| GMA012 | A2 domain 497-510; 584-593 | | GMA |
| GMA8001 | A3 Domain | 156 | GMA |
| GMA8002 | A1 Domain | <1 | GMA |
| GMA8003 | C2 Domain | | GMA |
| GMA8004 | A1 Domain | | GMA |
| GMA8005 | A1 A3/A1 Domain | | GMA |
| GMA8006 | C2 Domain | | GMA |
| GMA8008 | C2 Domain | 1047 | GMA |
| GMA8009 | A2 Domain | 7923 | GMA |
| GMA8010 | LC Domain | | GMA |
| GMA8011 | C1 Domain | 97 | GMA |
| GMA8012 | A1A3 Domain | 204 | GMA |
| GMA8013 | A3C2 Domain | 30 | GMA |
| GMA8014 | C2 Domain | 7799 | GMA |
| GMA8015 | A2 Domain | 17079 | GMA |
| GMA8016 | A2 Domain | <1 | GMA |
| GMA8017 | A2 Domain | 334 | GMA |
| GMA8018 | LC Domain | 242 | GMA |
| GMA8019 | CR-LC Domain | | GMA |
| GMA8020 | A1 A3 Domain | 196 | GMA |
| GMA8021 | A2 Domain | 33928 | GMA |
| 4A4 | A2 Domain | 40000 | J Thromb Haemost (2009) 7: 658-664 |
| 3E6 | C2 Domain | 41 | Blood (2007) 110: 4234-4242 |

American Diagnostica Inc. internet site, URL located on the World Wide Web at americandiagnostica.com/html/Product_Detail.asp?idCategory=5&idSubCategory=104&idpro=ESH-8 as it existed on Jan. 12, 2012

Green Mountain Antibodies internet site, URL located on the World Wide Web at greenmoab.com/product_details/16316/21582.html as it existed on Jan. 12, 2012

Assays for Inhibitor and Antibody Binding

The fusion proteins of the invention may be assayed to confirm reduced binding by FVIII inhibitors using methods known in the art. The assays that can be used include, but are not limited to, competitive and non-competitive assay systems using techniques such as Western blots, radioimmunoassays, ELISA, "sandwich" immunoassays, immunoprecipitation assays, precipitin reactions, gel diffusion precipitin reactions, immunodiffusion assays, agglutination assays, immunoradiometric assays, fluorescent immunoassays, clotting assays, factor VIII inhibitor assays to name but a few. Such assays are routine and well known in the art (see, e.g., Ausubel et al, eds, 1994, Current Protocols in Molecular Biology, Vol. 1, John Wiley & Sons, Inc., New York, which is incorporated by reference herein in its entirety). Exemplary are described briefly below but are not intended by way of limitation.

The Bethesda assay and the Nijmegen modification of the Bethesda assay are factor VIII inhibitor assays well-known as methods to detect FVIII inhibitors (Kasper C K, et al. Proceedings: A more uniform measurement of factor VIII inhibitors. Thromb Diath Haemorrh. (1975) 34(2):612). However, the assays can be modified to assay binding of inhibitors to FVIII compositions using inhibitors such as polyclonal or monoclonal anti-FVIII antibodies, including the antibodies of Table 10, and methods such as described in Example 52. Briefly, the modified Bethesda assay involves mixing titered volumes of the test sample with an equal volume of an inhibitor at a set concentration. The mixtures are incubated for 2 hours at 37° C. prior to analysis of the factor concentration by a coagulation assay such as a chromogenic assay. Similarly, a reference plasma with native factor VIII level is incubated that then assayed as the positive control. The endpoint is the titer resulting in 50% of the FVIII activity of the positive control, reported as Bethesda units. In the Nijimegen modification of the Bethesda assay, the assay samples are stabilized with imidazole buffer and the control sample is mixed with deficient plasma instead of buffer (Verbruggen B, et al. The Nijmegen modification of the Bethesda assay for factor VIII:C inhibitors: improved specificity and reliability. Thromb Haemost. (1995) 73(2):247-251).

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody (the antibody of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., 32 P or 125 I) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al, eds, 1994, Current Protocols in Molecular Biology, Vol. 1, John Wiley & Sons, Inc., New York at 10.8.1.

ELISA assays can detect antibodies to FVIII independent of their ability to block the procoagulant activity of FVIII, and have been utilized for the detection of anti-FVIII developing in hemophilia A patients. In a population of 131 patients with hemophilia A with inhibitors, the ELISA technique resulted in 97.7% sensitivity and 78.8% specificity, and had a high negative predictive value (98.6%) [Martin, P. G., et al. Evaluation of a novel ELISA screening test for detection of factor VIII inhibitory antibodies in haemophiliacs. Clin Lab Haematol (1999) 21:125-128]. Other investigators have found a highly significant correlation between the Bethesda titer and the absorbance values in an ELISA assay for detecting anti-FVIII Abs (Towfighi, F., et al. Comparative measurement of anti-factor VIII antibody by Bethesda assay and ELISA reveals restricted isotype profile and epitope specificity. Acta Haematol (2005) 114: 84-90), with the added advantage of the ability to detect non-inhibitory anti-FVIII antibodies. Assay protocols comprise preparing the binding ligand, which may include a sample comprising either factor VIII polypeptide or the CFXTEN fusion protein, coating the well of a 96 well microtiter plate with the antibody, adding the ligand test sample and incubating, then adding a detection antibody and incubating prior to washing and adding a alkaline phosphatase- or peroxidase-conjugated secondary antibody and incubating for an additional period before the addition of TMB substrate and processing for reading by spectrophotometer at 450 nm. In ELISAs the antibody or inhibitor of interest does not have to be conjugated to a detectable compound; instead, a second antibody (which recognizes the antibody or inhibitor of interest) conjugated to a detectable compound may be added to the well. Further, instead of coating the well with the antibody, the ligand may be coated to the well. One of skill in the art would be knowledgeable as to the parameters that can be modified to increase the signal detected as well as other variations of ELISAs known in the art (see, e.g., Ausubel et al, eds, 1994, Current Protocols in Molecular Biology, Vol. 1, John Wiley & Sons, Inc., New York at 11.2.1).

Standard or modified coagulation assays are used to measure reduced binding of FVIII binding agents. In one exemplary method (further described in Example 28), the optimal concentration of a given FVIII inhibitor to utilize in the assay is first determined by a titration experiment using varying amounts of the inhibitory antibody incubated at 37° C. for 2 hrs with the base vector expressing wild-type FVIII containing a His/Myc double tag. The FVIII activity is measured by the Coatest assay procedure described herein. The lowest concentration that results in optimal inhibition of FVIII activity is employed in the assay. In the assay, the FVIII inhibitor antibody at the optimal concentration is mixed with individual test samples and incubated at 37° C. for 2 hrs. The resulting test samples are then collected and utilized in the Coatest activity assay, along with untreated aliquots of the CFXTEN and positive control in order to assess the residual and baseline FVIII activity for each test sample.

The invention provides methods of making CFXTEN that exhibit reduced binding to FVIII binding agents, including FVIII inhibitors, and retention of procoagulant activity. In one embodiment, the method to make a CFXTEN with reduced binding to FVIII inhibitors comprises the steps of selecting a FVIII sequence with at least 90% sequence identity to a sequence of Table 1, selecting one, two, three, four, five, or six or more XTEN each with at least 70%, or at least 80%, or at least 90%, or at least 95-99% sequence identity to XTEN sequences of comparable length from Table 4, creating expression constructs designed to locate said XTEN at or proximal to locations selected from Table 5, Table 6, Table 7, Table 8, and Table 9, expressing and recovering the resulting CFXTEN, and assaying the resulting fusion proteins in an assay described herein in order to confirm the reduced binding of the CFXTEN fusion protein. By the inventive method, a CFXTEN exhibits at least 5% reduced, or at least 10% reduced, or at least 15% reduced, or at least 20% reduced, or at least 25% reduced, or at least 40% reduced, or at least 50% reduced, or at least 60% reduced, or at least 70% reduced, or at least 80% reduced binding to a FVIII binding agent including, but not limited to the antibodies of Table 10 or anti-FVIII antibodies from a hemophilia A subject, and retains at least about 10%, or at least about 20%, or at least about 30%, or at least about 40%, or at least about 50%, or at least about 60%, or at least about 70% procoagulant activity compared to the corresponding FVIII not linked to XTEN.

Up to 8-10% of hemophilia A patients have antibodies that bind FVIII without affecting its procoagulant properties; they are not, therefore categorized as FVIII inhibitors. However, the binding of antibodies to FVIII is believed to lead to immune complexes that are cleared by the innate immune response or are more susceptible to proteolytic degradation (Kazatchkine M D. Circulating immune complexes containing anti-VIII antibodies in multi-transfused patients with haemophilia A. Clin Exp Immunol. (1980) 39(2):315-320). Accordingly, it is an object of the invention to provide CFXTEN fusion proteins comprising one or more XTEN that exhibit reduced binding of antibodies to FVIII that are not inhibitors, wherein the degradation or clearance of the CFXTEN is reduced at least 5%, or 10%, or 15%, or 20%, or 30%, or 40%, or 50%, or 60%, or 70% or less compared to a corresponding FVIII not linked to XTEN or to native FVIII bound by such antibodies. The reduced binding of antibodies to CFXTEN compared to FVIII not linked to XTEN or to native FVIII can be assayed by in vitro and in vivo methods. In vitro methods include the aforementioned ELISA and Western blot methods. The reduced degradation or clearance of CFXTEN can be assessed in vivo by use of animal models or in human clinical trials. In one type of trial, factor VIII or CFXTEN are administered separately, preferably by intravenous infusion, to cohorts of patients having factor VIII deficiency who have antibodies that promote degradation or clearance of therapeutic human factor VIII. The dosage of the administered test article is in a range between 5 and 50 IU/kg body weight, preferably 10-45 IU/kg, and most preferably 40 IU/kg body weight. Approximately 1 hour after each administration, the recovery of factor VIII or CFXTEN from blood samples is measured in a functional one-stage or chromogenic coagulation assay to assess activity and by ELISA, HPLC, or similar assay to qualify the amount of intact factor VIII equivalent. Samples are taken again approximately 5-10 hours after infusion, and recovery is measured. Total recovery and the rate of disappearance of factor VIII from the samples is predictive of the antibody titer, and the comparison of results from the factor VIII and CFXTEN indicates the degree of reduced clearance and/or degradation of the CFXTEN. In one embodiment, the CFXTEN fusion protein exhibits at least 5% reduced, or at least 10% reduced, or at least 15% reduced, or at least 20% reduced, or at least 25% reduced, or at least 40% reduced, or at least 50% reduced, or at least 60% reduced, or at least 70% reduced, or at least 80% reduced binding to an anti-FVIII antibody that promotes clearance but does not otherwise inhibit the procoagulant activity of intact native FVIII. In another embodiment, the CFXTEN fusion protein exhibits at least 5% reduced, or at least 10% reduced, or at least 15% reduced, or at least 20% reduced, or at least 25% reduced, or at least 40% reduced, or at least 50% reduced, or at least 60% reduced, or at least 70% reduced, or at least 80% reduced binding to an anti-FVIII antibody that promotes the degradation of FVIII. In the foregoing embodiments of this paragraph, the reduced binding of the anti-FVIII antibody is alternatively characterized by an increased $K_D$ value of the FVIII antibody to the fusion protein compared to the FVIII of at least two-fold, or three-fold, or four-fold, or five-fold, or 10-fold, or 33-fold, or 100-fold, or 330-fold, or at least 1000-fold compared to the binding to the corresponding FVIII not linked to XTEN. In one embodiment, the CFXTEN fusion proteins comprising one or more XTEN exhibiting reduced reactivity to an anti-FVIII antibody exhibits an increased terminal half-life when administered to a subject with anti-FVIII antibodies of at least 48 h, or at least 72 h, or at least 96 h, or at least 120 h, or at least 144 h, or at least 14 days, or at least 21 days compared to FVIII not linked to XTEN. In the foregoing embodiment, the subject can be a human hemophilia A subject or it can be a mouse hemophilia A subject with circulating anti-FVIII antibodies.

Another aspect of the present invention is the use of CFXTEN fusion protein for a specific therapy of a coagulopathy in a subject with a FVIII inhibitor. The invention provides a method of treating a subject with circulating FVIII inhibitor(s) comprising the step of administering a clotting-effective amount of a CFXTEN fusion protein to the subject wherein the fusion protein exhibits greater procoagulant activity and/or clotting-effective concentrations of longer duration compared to either a corresponding factor VIII not linked to XTEN or compared to native factor VIII administered to the subject using a comparable amount and route of administration. In one embodiment of the method, the FVIII inhibitor in the subject is an anti-FVIII antibody. In another embodiment, the FVIII inhibitor is a neutralizing anti-FVIII antibody. In one embodiment, the FVIII inhibitor is an anti-FVIII antibody that binds to the A1 domain of FVIII. In another embodiment, the FVIII inhibitor is an anti-FVIII antibody that binds to the A2 domain of FVIII. In another embodiment, the FVIII inhibitor is an anti-FVIII antibody that binds to the A3 domain of FVIII. In another embodiment, the FVIII inhibitor is an anti-FVIII antibody that binds to the C1 domain of FVIII. In another embodiment, the FVIII inhibitor is an anti-FVIII antibody that binds to the C2 domain of FVIII. In another embodiment, the FVIII inhibitor is an anti-FVIII antibody that binds to both the C2 and A2 domain of FVIII. In another embodiment, the FVIII inhibitor binds to a FVIII epitope capable of being bound by one or more antibodies of Table 10. In another embodiment, the FVIII inhibitor is a polyclonal antibody from a hemophilia A subject with FVIII inhibitor antibodies.

An object of the present invention is the creation of CFXTEN with XTEN inserted to maximize the steric interference of FVIII binding agents that would otherwise bind to FVIII and neutralize procoagulant activity or result in the clearance or degradation of FVIII. Accordingly, in one approach the invention provides CFXTEN comprising one or more XTEN wherein the XTEN are inserted proximal to a binding site of a FVIII inhibitor or anti-FVIII antibody. In one embodiment, an XTEN is linked to the FVIII at a location selected from Table 5, Table 6, Table 7, Table 8, and Table 9 that is within about 50, or about 100, or about 150, or about 200, or about 250, or about 300 amino acids of a FVIII epitope that is bound by an antibody of Table 10. In another embodiment, the XTEN is linked to the FVIII within about 50, or about 100, or about 150, or about 200, or about 250, or about 300 amino acids of a FVIII epitope in the A2 or C2 domain that is bound by an antibody of Table 10. Accordingly, the invention provides CFXTEN fusion proteins comprising one or more XTEN wherein binding by FVIII inhibitors to the FVIII component of the fusion protein is reduced compared to the corresponding FVIII not linked to XTEN or to native FVIII and the CFXTEN retains procoagulant activity. In the foregoing embodiments hereinabove described in this paragraph, the fusion proteins can be assayed by the assays described herein below, the assays of the Examples, or other assays known in the art, and the inhibitors can be an antibody of Table 10, can be polyclonal anti-FVIII, or can be blood or plasma from a hemophilia A subject with FVIII inhibitors.

In another aspect, CFXTEN are designed to maximize the regions over which XTEN can adopt random coil conformations covering the fusion protein, thereby resulting in steric hindrance for anti-FVIII antibodies that would otherwise bind epitopes on the FVIII component of the fusion protein. It is believed that the incorporation of multiple XTEN into a CFXTEN provides a higher total hydrodynamic radius of the XTEN component compared to CFXTEN with fewer XTEN yet having approximately the same total of XTEN amino acids. Empirically, the hydrodynamic radius for a protein can be calculated based on size exclusion chromatography, and results of several fusion proteins using such methods are described in the Examples. Alternatively, the radius for XTEN polypeptides, such as those incorporated in the embodiments disclosed herein, can be approximated by mathematical formulae because the limited types of amino acids utilized have known characteristics that can be quantified. In one embodiment, the maximum radius of a single XTEN polypeptide is calculated (hereinafter "XTEN Radius") according to the formula given by Equation II:

$$\text{XTEN Radius} = (\sqrt{\text{XTEN length}} \cdot 0.2037) + 3.4627 \quad \text{II}$$

In another embodiment, the sum of the maximum of the XTEN Radii for all XTEN segments in a CFXTEN is calculated (hereinafter "Sum XTEN Radii") according to the formula given by Equation III:

$$\text{Sum } XTEN \text{ Radii} = \sum_{i=1}^{m} XTEN \text{ Radius}_i \quad \text{III}$$

wherein: n=the number of XTEN segments
and i is an iterator

In another embodiment, the ratio of the SUM XTEN Radii of a CFXTEN comprising multiple XTEN to that of an XTEN Radius for a single XTEN of an equivalent length (in total amino acid residues to that of the CFXTEN) is calculated (hereinafter "Ratio XTEN Radii") according to the formula given by Equation IV:

$$\text{Ratio } XTEN \text{ Radii} = \frac{\sum_{i=1}^{n} XTEN \text{ Radius}_i}{\left(\sqrt{\sum_{i=1}^{n} XTEN \text{ Length}_i} * 0.2037\right) + 3.4627} \quad \text{IV}$$

wherein: n=the number of XTEN segments
and i is an iterator

In applying the Equations to the XTEN, it will be understood by one of skill in the art that the calculated values represent maximum values that could vary or be reduced depending on the host cell utilized for expression of the XTEN polypeptide. It is believed that while *E. coli* expression would result in XTEN that achieves the calculated values, expression in eukaryotic host cells in which XTEN may be glycosylated could result in a radius of the polypeptide less than the maximum calculated value. Such differences can be quantified by methods such as size exclusion chromatography, the methods of which are detailed in the Examples.

In order to design CFTEN that maximize the area over which XTEN can adopt random coil conformations, it was discovered that CFXTEN designs with Ratio XTEN Radii above 2 provide greater coverage over the fusion protein than designs with values <2. Accordingly, in one embodiment the invention provides CFXTEN in which the Ratio XTEN Radii is at least 2.0, or 2.1, or 2.2, or 2.3, or 2.4, or 2.5, or 2.6, or 2.7, or 2.8, or 2.9, or 3.0, or 3.1, or 3.2, or 3.3, or 3.4, or 3.5 or greater. In some embodiments, the invention provides CFXTEN in which the Ratio XTEN Radii is at least 2.0-3.5 or greater comprise at least three XTEN with each XTEN having at least 42 to about 288 amino acids and wherein at least two of the XTEN are linked to the fusion protein with no less than about 100, or about 200, or about 300, or about 400, or about 500 amino acids of separation between the two XTEN. In other embodiments, the invention provides CFXTEN in which the Ratio XTEN Radii is at least 2.0-3.5 or greater comprise at least four XTEN with each XTEN having at least 42 to about 288 amino acids and wherein at least three of the XTEN are linked to the fusion protein with no less than about 100, or about 200, or about 300, or about 400 amino acids of separation between any two of the three XTEN.

In another embodiment, the invention provides a CFXTEN in which the Ratio XTEN Radii is at least 2.0-3.5 or greater, the CFXTEN comprises at least three XTEN with each XTEN having at least 42 to about 288 amino acids and wherein at least two of the three of the XTEN linked to the fusion protein are separated by an amino acid sequence of at least 100, or about 200, or about 300 to about 400 amino acids, and the third XTEN is linked within the B domain (or fragment thereof) or within the C domain (or the terminus thereof). In another embodiment, the invention provides a CFXTEN in which the Ratio XTEN Radii is at least 2.0-3.5 or greater, the CFXTEN comprises at least four XTEN with each XTEN having at least 42 to about 288 amino acids and wherein at least three of the four of the XTEN linked to the fusion protein are separated by an amino acid sequence of at least 300 to about 400 amino acids and the fourth XTEN is linked within the B domain (or fragment thereof) or within the C domain (or the terminus thereof).

In yet other embodiments, the invention provides CFXTEN in which the Ratio XTEN Radii is at least 2.0-3.5 or greater, the CFXTEN comprises at least five XTEN with four XTEN having at least 42 to about 144 amino acids wherein at least four of the XTEN are linked to the fusion protein with no less than about 100, 200, or about 300, or about 400 amino acids of separation between any two of the four XTEN and a fifth XTEN is linked within the B domain (or fragment thereof) or within the C domain (or the terminus thereof). In one embodiment, the invention provides a CFXTEN in which the Ratio XTEN Radii is at least 2.0-3.5 or greater, the CFXTEN comprises at least five XTEN with four XTEN having at least 42 to about 144 amino acids wherein at least three of the XTEN linked to the fusion protein are separated by an amino acid sequence of at least 300 to about 400 amino acids, the fourth XTEN is linked within the B domain (or fragment thereof) and a fifth XTEN is linked within the C domain (or the terminus thereof).

In one aspect, the invention provides CFXTEN in which the Ratio XTEN Radii is at least 2.0, or 2.1, or 2.2, or 2.3, or 2.4, or 2.5, or 2.6, or 2.7, or 2.8, or 2.9, or 3.0, or 3.1, or 3.2, or 3.3, or 3.4, or 3.5 or greater, and the composition does not comprise certain sequences. In one embodiment of the foregoing, the invention provides CFXTEN in which the Ratio XTEN Radii is at least 2.0-3.5 or greater with the proviso that the fusion protein does not comprise a sequence from any one of Table 50 or Table 51. In another embodiment of the foregoing, the invention provides CFXTEN in which the Ratio XTEN Radii is at least 2.0-3.5 or greater with the proviso that the fusion protein does not comprise a sequence having an AG family XTEN sequence. In another embodiment of the foregoing, the invention provides CFXTEN in which the Ratio XTEN Radii is at least 2.0-3.5 or greater with the proviso that the fusion protein does not comprise a sequence selected from GTPGSGTASSSP (SEQ ID NO: 31), GSSTPSGATGSP (SEQ ID NO: 32), GSSPSASTGTGP (SEQ ID NO: 33), GASPGTSSTGSP (SEQ ID NO: 34). In another embodiment of the foregoing, the invention provides CFXTEN in which the Ratio XTEN Radii is at least 2.0-3.5 or greater with the proviso that the fusion protein does not comprise any one of the sequences selected from GTPGSGTASSSP (SEQ ID NO: 31), GSSTPSGATGSP (SEQ ID NO: 32), GSSPSASTGTGP (SEQ ID NO: 33), GASPGTSSTGSP (SEQ ID NO: 34) and GSEPATSGSETPGTSESATPESGPGSEPATSGSETPG-SPAGSPTSTEEGTSTEPSEGSAPGSEPATSG SETPGSE-PATSGSETPGSEPATSGSETPGTSTEPSEGSAPGT-SESATPESGPGSEPATSGSETPGTST EPSEGSAP (SEQ ID NO: 59). In another embodiment of the foregoing, the invention provides CFXTEN in which the Ratio XTEN Radii is at least 2.0-3.5 or greater with the proviso that the fusion protein does not comprise a sequence selected from GSEPATSGSETPGTSESATPESGPGSEPATSGSETPG-SPAGSPTSTEEGTSTEPSEGSAPGSEPATSG SETPGSE-PATSGSETPGSEPATSGSETPGTSTEPSEGSAPGT-SESATPESGPGSEPATSGSETPGTST EPSEGSAP (SEQ ID NO: 59), PGSSPSASTGTGPGSSPSASTGTGPGTPGS-GTASSSPGSSTPSGATGSPGSSPSASTGTGPGASPGTS STGSPGTPGSGTASSSPGSSTPSGATGSPGTPGSG-TASSSPGASPGTSSTGSPGASPGTSSTGSPGTP GSG-TASSS (SEQ ID NO: 71), or PGASPGTSSTGSP-GASPGTSSTGSPGTPGSGTASSSPGSSTPSGATGSPG-TPGSGTASSSPGSSTPSG ATGSPGTPGSGTASSSPGSSTPSGATGSPGSSTPS-GATGSPGSSPSASTGTGPGSSPSASTGTGPGA SPGTSSTGSPGTPGSGTASSSPGSSTPSGATG-SPGSSPSASTGTGPGSSPSASTGTGPGASPGTSSTG SPGASPGTSSTGSPGSSTPSGATGSPGSSPSASTGTGP-GASPGTSSTGSPGSSPSASTGTGPGTPGSG TASSSPGSSTPSGATGS (SEQ ID NO: 80). In another embodiment of the foregoing, the invention provides CFXTEN in which the Ratio XTEN Radii is at least 2.0-3.5 or greater with the proviso that the fusion protein does not comprise an XTEN sequence consisting of GSEPATSGSET-PGTSESATPESGPGSEPATSGSETPGSPAGSPTSTEEGT-STEPSEGSAPGSEPATSG SETPGSEPATSGSETPGSE-PATSGSETPGTSTEPSEGSAPGTSESATPESGPGSEPA-TSGSETPGTST EPSEGSAP (SEQ ID NO: 59), PGSSPSASTGTGPGSSPSASTGTGPGTPGSG-TASSSPGSSTPSGATGSPGSSPSASTGTGPGASPGTS STGSPGTPGSGTASSSPGSSTPSGATGSPGTPGSG-TASSSPGASPGTSSTGSPGASPGTSSTGSPGTP GSG-TASSS (SEQ ID NO: 71), or PGASPGTSSTGSP-GASPGTSSTGSPGTPGSGTASSSPGSSTPSGATGSP-GTPGSGTASSSPGSSTPSG ATGSPGTPGSGTASSSPGSSTPSGATGSPGSSTPS-
GATGSPGSSPSASTGTGPGSSPSASTGTGPGA
SPGTSSTGSPGTPGSGTASSSPGSSTPSGATG-
SPGSSPSASTGTGPGSSPSASTGTGPGASPGTSSTG
SPGASPGTSSTGSPGSSTPSGATGSPGSSPSASTGTGP-
GASPGTSSTGSPGSSPSASTGTGPGTPGSG
TASSSPGSSTPSGATGS (SEQ ID NO: 80).

In one aspect, the present invention provides methods to create CFXTEN with XTEN inserted to maximize the steric interference of FVIII binding agents that would otherwise bind to FVIII and neutralize procoagulant activity or result in the clearance or degradation of FVIII. Accordingly, in one embodiment, the invention provides a method comprising the steps of selecting a FVIII sequence with at least 90% sequence identity to a sequence of Table 1, selecting three or more XTEN from Table 4 in which the Ratio XTEN Radii is at least 2.0, or 2.1, or 2.2, or 2.3, or 2.4, or 2.5, or 2.6, or 2.7, or 2.8, or 2.9, or 3.0, or 3.1, or 3.2, or 3.3, or 3.4, or 3.5 or greater, creating expression constructs designed to locate said XTEN at or proximal to locations selected from Table 5, Table 6, Table 7, Table 8, and Table 9, wherein the three or more XTEN are at least 300 to 400 amino acids, expressing and recovering the resulting CFXTEN, and assaying the resulting fusion proteins in an assay described herein in order to confirm the reduced binding of the CFXTEN fusion protein. By the inventive method, a CFXTEN exhibits at least 5% reduced, or at least 10% reduced, or at least 15% reduced, or at least 20% reduced, or at least 25% reduced, or at least 40% reduced, or at least 50% reduced, or at least 60% reduced, or at least 70% reduced, or at least 80% reduced binding to a FVIII binding agent including, but not limited to the antibodies of Table 10, and exhibits procoagulant activity.

5. CFXTEN Fusion Protein Configurations with Spacer and Cleavage Sequences

In another aspect, the invention provides CFXTEN configured with one or more spacer sequences incorporated into or adjacent to the XTEN that are designed to incorporate or enhance a functionality or property to the composition, or as an aid in the assembly or manufacture of the fusion protein compositions. Such properties include, but are not limited to, inclusion of cleavage sequence(s) to permit release of components, inclusion of amino acids compatible with nucleotide restrictions sites to permit linkage of XTEN-encoding nucleotides to FVIII-encoding nucleotides or that facilitate construction of expression vectors, and linkers designed to reduce steric hindrance in regions of CFXTEN fusion proteins.

In an embodiment, a spacer sequence can be introduced between an XTEN sequence and a FVIII component to decrease steric hindrance such that the FVIII component may assume its desired tertiary structure and/or interact appropriately with its target substrate or processing enzyme. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the natural L amino acids, and will preferably have XTEN-like properties in that the majority of residues will be hydrophilic amino acids that are sterically unhindered such as, but not limited to, glycine (G), alanine (A), serine (S), threonine (T), glutamate (E), proline (P) and aspartate (D). The spacer can be a single glycine residue, polyglycines or polyalanines, or is predominately a mixture of combinations of glycine, serine and alanine residues. In one embodiment, a spacer sequence, exclusive of cleavage site amino acids, has about 1 to 10 amino acids that consist of amino acids selected from glycine (G), alanine (A), serine (S), threonine (T), glutamate (E), and proline (P) and are substantially devoid of secondary structure; e.g., less than about 10%, or less than about 5% as determined by the Chou-Fasman and/or GOR algorithms. In one embodiment, the spacer sequence is GPEGPS (SEQ ID NO: 1612). In another embodiment, the spacer sequence is GPEGPS (SEQ ID NO: 1612) linked to a cleavage sequence of Table 12. In addition, spacer sequences are designed to avoid the introduction of T-cell epitopes which can, in part, be achieved by avoiding or limiting the number of hydrophobic amino acids utilized in the spacer; the determination of epitopes is described above and in the Examples.

In a particular embodiment, the CFXTEN fusion protein comprises one or more spacer sequences linked at the junction(s) between the payload FVIII sequence and the one or more XTEN incorporated into the fusion protein, wherein the spacer sequences comprise amino acids that are compatible with nucleotides encoding restriction sites. In another embodiment, the CFXTEN fusion protein comprises one or more spacer sequences linked at the junction(s) between the payload FVIII sequence and the one more XTEN incorporated into the fusion protein wherein the spacer sequences comprise amino acids that are compatible with nucleotides encoding restriction sites and the amino acids and the one more spacer sequence amino acids are chosen from glycine (G), alanine (A), serine (S), threonine (T), glutamate (E), and proline (P). In another embodiment, the CFXTEN fusion protein comprises one or more spacer sequences linked at the junction(s) between the payload FVIII sequence and one more XTEN incorporated into the fusion protein wherein the spacer sequences comprise amino acids that are compatible with nucleotides encoding restriction sites and the one more spacer sequences are chosen from the sequences of Table 11. The exact sequence of each spacer sequence is chosen to be compatible with cloning sites in expression vectors that are used for a particular CFXTEN construct. In one embodiment, the spacer sequence has properties compatible with XTEN. In one embodiment, the spacer sequence is GAGSPGAETA (SEQ ID NO: 178). For XTEN sequences that are incorporated internal to the FVIII sequence, each XTEN would generally be flanked by two spacer sequences comprising amino acids compatible with restriction sites, while XTEN attached to the N- or C-terminus would only require a single spacer sequence at the junction of the two components and another at the opposite end for incorporation into the vector. As would be apparent to one of ordinary skill in the art, the spacer sequences comprising amino acids compatible with restriction sites that are internal to FVIII could be omitted from the construct when an entire CFXTEN gene is synthetically generated.

TABLE 11

Spacer Sequences Compatible with Restriction Sites

| Spacer Sequence | Restriction Enzyme |
| --- | --- |
| GSPG (SEQ ID NO: 174) | BsaI |
| ETET (SEQ ID NO: 175) | BsaI |
| PGSSS (SEQ ID NO: 176) | BbsI |

TABLE 11-continued

Spacer Sequences Compatible with Restriction Sites

| Spacer Sequence | Restriction Enzyme |
|---|---|
| GAP | AscI |
| GPA | FseI |
| GPSGP (SEQ ID NO: 177) | SfiI |
| AAA | SacII |
| TG | AgeI |
| GT | KpnI |
| GAGSPGAETA (SEQ ID NO: 178) | SfiI |
| ASS | XhoI |

In another aspect, the present invention provides CFXTEN configurations with cleavage sequences incorporated into the spacer sequences. In some embodiments, spacer sequences in a CFXTEN fusion protein composition comprise one or more cleavage sequences, which are identical or different, wherein the cleavage sequence may be acted on by a protease, as shown in FIG. 12, to release FVIII, a FVIII component (e.g., the B domain) or XTEN sequence(s) from the fusion protein. In one embodiment, the incorporation of the cleavage sequence into the CFXTEN is designed to permit release of the FVIII component that becomes active or more active (with respect to its ability serve as a membrane binding site for factors IXa and X) upon its release from the XTEN. In the foregoing embodiment, the procoagulant activity of FVIII component of the CFXTEN is increased after cleavage by at least 30%, or at least 40%, or at least 50%, or at least 60%, or at least 70%, or at least 80%, or at least 90% compared to the intact CFXTEN. The cleavage sequences are located sufficiently close to the FVIII sequences, generally within 18, or within 12, or within 6, or within 2 amino acids of the FVIII sequence, such that any remaining residues attached to the FVIII after cleavage do not appreciably interfere with the activity (e.g., such as binding to a clotting protein) of the FVIII, yet provide sufficient access to the protease to be able to effect cleavage of the cleavage sequence. In some cases, the CFXTEN comprising the cleavage sequences will also have one or more spacer sequence amino acids between the FVIII and the cleavage sequence or the XTEN and the cleavage sequence to facilitate access of the protease; the spacer amino acids comprising any natural amino acid, including glycine, serine and alanine as preferred amino acids. In one embodiment, the cleavage site is a sequence that can be cleaved by a protease endogenous to the mammalian subject such that the CFXTEN can be cleaved after administration to a subject. In such case, the CFXTEN can serve as a prodrug or a circulating depot for the FVIII. In a particular construct of the foregoing, the CFXTEN would have one or two XTEN linked to the N- and/or the C-terminus of a FVIII-BDD via a cleavage sequence that can be acted upon by an activated coagulation factor, and would have an additional XTEN located between the processing amino acids at position R740 and R1689 such that the XTEN could be released, leaving a form of FVIII similar to native activated FVIII. In one embodiment of the foregoing construct, the FVIII that is released from the fusion protein by cleavage of the cleavage sequence exhibits at least about a two-fold, or at least about a three-fold, or at least about a four-fold, or at least about a five-fold, or at least about a six-fold, or at least about a eight-fold, or at least about a ten-fold, or at least about a 20-fold increase in activity compared to the intact CFXTEN fusion protein.

Examples of cleavage sites contemplated by the invention include, but are not limited to, a polypeptide sequence cleavable by a mammalian endogenous protease selected from FXIa, FXIIa, kallikrein, FVIIIa, FVIIIa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases and others are known in the art. Exemplary cleavage sequences contemplated by the invention and the respective cut sites within the sequences are presented in Table 12, as well as sequence variants thereof. For CFXTEN comprising incorporated cleavage sequence (s), it is generally preferred that the one or more cleavage sequences are substrates for activated clotting proteins. For example, thrombin (activated clotting factor II) acts on the sequence LTPRSLLV (SEQ ID NO: 1618) [Rawlings N. D., et al. (2008) Nucleic Acids Res., 36: D320], which is cut after the arginine at position 4 in the sequence. Active FIIa is produced by cleavage of FII by FXa in the presence of phospholipids and calcium and is down stream from factor VIII in the coagulation pathway. Once activated, its natural role in coagulation is to cleave fibrinogen, which then in turn, begins clot formation. FIIa activity is tightly controlled and only occurs when coagulation is necessary for proper hemostasis. By incorporation of the LTPRSLLV sequence (SEQ ID NO: 1618) into the CFXTEN between and linking the FVIII and the XTEN components, the XTEN is removed from the adjoining FVIII concurrent with activation of either the extrinsic or intrinsic coagulation pathways when coagulation is required physiologically, thereby selectively releasing FVIII. In another embodiment, the invention provides CFXTEN with incorporated FXIa cleavage sequences between the FVIII and XTEN component(s) that are acted upon only by initiation of the intrinsic coagulation system, wherein a procoagulant form of FVIII is released from XTEN by FXIa to participate in the coagulation cascade. While not intending to be bound by any particular theory, it is believed that the CFXTEN of the foregoing embodiment would sequester the FVIII away from the other coagulation factors except at the site of active clotting, thus allowing for larger doses (and therefore longer dosing intervals) with minimal safety concerns.

Thus, cleavage sequences, particularly those susceptible to the procoagulant activated clotting proteins listed in Table 12, would provide for sustained release of FVIII that, in certain embodiments of the CFXTEN, can provide a higher degree of activity for the FVIII component released from the intact form of the CFXTEN, as well as additional safety margin for high doses of CFXTEN administered to a subject. In one embodiment, the invention provides CFXTEN comprising one or more cleavage sequences operably positioned to release the FVIII from the fusion protein upon cleavage, wherein the one or more cleavage sequences has at least about 86%, or at least about 92%, or 100% sequence identity to a sequence selected from Table 12.

In some embodiments, only the two or three amino acids flanking both sides of the cut site (four to six amino acids total) are incorporated into the cleavage sequence that, in turn, is incorporated into the CFXTEN of the embodiments, providing, e.g., XTEN release sites. In other embodiments, the incorporated cleavage sequence of Table 12 can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the FVIII from the XTEN. Exemplary substitutions within cleavage sequences that are utilized in the CFXTEN of the 86%, 87%, 88%, 89%, 90%, 91%, 92%, 93%, 94%, 95%, 96%, 97%, 98%, 99%, or about 100% sequence identity as compared to a CFXTEN from Table 21, when optimally aligned. In another embodiment, a CFXTEN composition comprises a fusion protein from Table 21 in which the C-terminal his-his-his-his-his-his sequence (SEQ ID NO: 1700) deleted. However, the invention also contemplates substitution of any of the FVIII sequences of Table 1 for a

TABLE 12

Protease Cleavage Sequences

| Protease Acting Upon Sequence | Exemplary Cleavage Sequence | SEQ ID NO: | Minimal Cut Site | SEQ ID NO: |
|---|---|---|---|---|
| FXIa | KLTR↓AET | 179 | KD/FL/T/R↓VA/VE/GT/GV | |
| FXIa | DFTR↓VVG | 180 | KD/FL/T/R↓VA/VE/GT/GV | |
| FXIIa | TMTR↓IVGG | 181 | NA | |
| Kallikrein | SPFR↓STGG | 182 | -/-/FL/RY↓SR/RT/-/- | |
| FVIIa | LQVR↓IVGG | 183 | NA | |
| FIXa | PLGR↓IVGG | 184 | -/-/G/R↓-/-/-/- | |
| FXa | IEGR↓TVGG | 185 | IA/E/GFP/R↓STI/VFS/-/G | |
| FIIa (thrombin) | LTPR↓SLLV | 186 | -/-/PLA/R↓SAG/-/-/- | |
| Elastase-2 | LGPV↓SGVP | 187 | -/-/-/VIAT↓-/-/-/- | |
| Granzyme-B | VAGD↓SLEE | 188 | V/-/-/D↓-/-/-/- | |
| MMP-12 | GPAG↓LGGA | 189 | G/PA/-/G↓L/-/G/- | 190 |
| MMP-13 | GPAG↓LRGA | 191 | G/P/-/G↓L/-/GA/- | 192 |
| MMP-17 | APLG↓LRLR | 193 | -/PS/-/-↓LQ/-/LT/- | |
| MMP-20 | PALP↓LVAQ | 194 | NA | |
| TEV | ENLYFQ↓G | 195 | ENLYFQ↓G/S | 196 |
| Enterokinase | DDDK↓IVGG | 197 | DDDK↓IVGG | 198 |
| Protease 3C (PreScission ™) | LEVLFQ↓GP | 199 | LEVLFQ↓GP | 200 |
| Sortase A | LPKT↓GSES | 201 | L/P/KEAD/T↓G/-/EKS/S | 202 |

↓indicates cleavage site NA: not applicable
the listing of multiple amino acids before, between, or after a slash indicate alternative amino acids that can be substituted at the position; "−" indicates that any amino acid may be substituted for the corresponding amino acid indicated in the middle column 6. Exemplary CFXTEN Fusion Protein Sequences Non-limiting examples of sequences of fusion proteins containing a single FVIII linked to one or more XTEN are presented in Table 21. The exemplary amino acid sequences of Table 21 (and the DNA sequences that encode them) contain his tags for purification purposes that, as would be apparent to one of skill in the art, can be deleted from the sequence without having an effect on the procoagulant activity of the CFXTEN fusion protein. In one embodiment, the CFXTEN of Table 21 further comprise amino acids on the N-terminus corresponding to that of native human FVIII (namely, the sequence MQIELSTCFFLCLLRFCFS (SEQ ID NO: 1611)) to aid in the expression and secretion of the CFXTEN fusion protein. In one embodiment, a CFXTEN composition comprises a fusion protein having at least about 80% sequence identity compared to a CFXTEN from Table 21, alternatively at least about 81%, 82%, 83%, 84%, 85%, FVIII component of the CFXTEN of Table 21, and/or substitution of any sequence of any one of Tables 3, 4, and 13-17 for an XTEN component of the CFXTEN of Table 21. Generally, the resulting CFXTEN of the foregoing examples retain at least a portion of the procoagulant activity of the corresponding FVIII not linked to the XTEN. In the foregoing fusion proteins hereinabove described in this paragraph, the CFXTEN fusion protein can further comprise one or more cleavage sequences; e.g., a sequence from Table 12, the cleavage sequence being located between the FVIII and the XTEN sequences or between adjacent FVIII domains linked by XTEN. In some embodiments comprising cleavage sequence(s), the intact CFXTEN composition has less activity but a longer half-life in its intact form compared to a corresponding FVIII not linked to the XTEN, but is designed such that upon administration to a subject, the FVIII component is gradually released from the fusion protein by cleavage at the cleavage sequence(s) by endogenous proteases, whereupon the FVIII component exhibits procoagulant activity.

The CFXTEN compositions of the embodiments can be evaluated for activity using assays or in vivo parameters as described herein (e.g., in vitro coagulation assays, assays of Table 49, or a pharmacodynamic effect in a preclinical hemophilia model or in clinical trials in humans, using methods as described in the Examples or other methods known in the art for assessing FVIII activity) to determine the suitability of the configuration or the FVIII sequence variant, and those CFXTEN compositions (including after cleavage of any incorporated XTEN-releasing cleavage sites) that retain at least about 30%, or about 40%, or about 50%, or about 55%, or about 60%, or about 70%, or about 80%, or about 90%, or about 95% or more activity compared to native FVIII sequence are considered suitable for use in the treatment of FVIII-related conditions.

V). Properties of the CFXTEN Compositions of the Invention (a) Pharmacokinetic Properties of CFXTEN It is an object of the present invention to provide CFXTEN fusion proteins and pharmaceutical compositions comprising CFXTEN with enhanced pharmacokinetics compared to FVIII not linked to XTEN. The pharmacokinetic properties of a FVIII enhanced by linking a given XTEN to the FVIII include, but are not limited to, terminal half-life, area under the curve (AUC), $C_{max}$, volume of distribution, maintaining the biologically active CFXTEN above a minimum effective blood unit concentration for a longer period of time compared to the FVIII not linked to XTEN. The enhanced properties permit less frequent dosing and/or a longer-lived procoagulant effect compared to a comparable dose of FVIII not linked to XTEN. Enhancement of one or more of these properties can resulting benefits in the treatment of factor VIII-related conditions.

Exogenously administered factor VIII has been reported to have a terminal half-life in humans of approximately 12-14 hours when complexed with normal von Willebrand factor protein, whereas in the absence of von Willebrand factor, the half-life of factor VIII is reduced to 2 hours (Tuddenham E G, et al., Br J Haematol. (1982) 52(2):259-267; Bjorkman, S., et al. Clin Pharmacokinet. (2001) 40:815). As a result of the enhanced properties conferred by XTEN, the CFXTEN, when used at the dose and dose regimen determined to be appropriate for the subject and its underlying condition, can achieve a circulating concentration resulting in a desired procoagulant or clinical effect for an extended period of time compared to a comparable dose of the corresponding FVIII not linked to XTEN. As used herein, a "comparable dose" means a dose with an equivalent moles/kg or International Units/kg (IU/kg) for the composition that is administered to a subject. It will be understood in the art that a "comparable dose" of FVIII not linked to XTEN would represent a lesser weight of drug but would have essentially the same IUs or mole-equivalents of CFXTEN in the dose.

An international unit ("IU") of factor VIII is defined in the art as the coagulant activity present in 1 ml of normal human plasma. A normal, non-hemophilic individual human is expected to have about 100 IU/dL factor VIII activity. In hemophilia A, the doses required to treat are dependent on the condition. For minor bleeding, doses of native or recombinant factor VIII of 20 to 40 IU/kg are typically administered, as necessary. For moderate bleeding, doses of 30 to 60 IU/kg are administered as necessary, and for major bleeding, doses of 80 to 100 IU/kg may be required, with repeat doses of 20 to 25 IU/kg given every 8 to 12 hours until the bleeding is resolved. For prophylaxis against bleeding in patients with severe hemophilia A, the usual doses of native or recombinant FVIII preparations are 20 to 40 IU/kg body weight at intervals of about 2 to 3 days. A standard equation for estimating an appropriate dose of a composition comprising FVIII is:

Required units=body weight (kg)×desired factor VIII rise (IU/dL or % of normal)×0.5 (IU/kg per IU/dL).

In many cases, the therapeutic levels for FVIII in subjects of different ages or degree of disease have been established and are available in published literature or are stated on the drug label for approved products containing the FVIII. For example, the Subcommittee on Factor VIII and Factor IX of the Scientific and Standardization Committee of the International Society on Thrombosis and Haemostasis posted, on the ISTH Website 29 Nov. 2000, that the most widely used measure of hemophilia A is established by determining the circulating concentrations of plasma FVIII procoagulant levels, with persons with <1% (<0.01 IU/ml) factor VIII defined as severe; 1-5% (0.01-0.05 IU/ml) as moderately severe; and >5-40% (0.05-<0.40 IU/ml) as mild, where normal is 1 IU/ml of factor VIIIC (100%). The therapeutic levels can be established for new compositions, including those CFXTEN and pharmaceutical compositions comprising CFXTEN of the disclosure, using standard methods. In practicing the present invention, it will be understood that any dosage of CFXTEN that is effective may be used for treating bleeding episodes or maintaining hemostasis. The methods for establishing the therapeutic levels and dosing schedules for a given composition are known to those of skill in the art (see, e.g., Goodman & Gilman's The Pharmacological Basis of Therapeutics, 11$^{th}$ Edition, McGraw-Hill (2005)). For example, by using dose-escalation studies in subjects with the target condition to determine efficacy or a desirable pharmacologic effect, appearance of adverse events, and determination of circulating blood levels, the therapeutic blood levels for a given subject or population of subjects can be determined for a given drug or biologic. The dose escalation studies would evaluate the activity of a CFXTEN through studies in a subject or group of hemophilia A subjects. The studies would monitor blood levels of procoagulant, as well as physiological or clinical parameters as known in the art or as described herein for one or more parameters associated with the factor VIII-related condition, or clinical parameters associated with a beneficial outcome, together with observations and/or measured parameters to determine the no effect dose, adverse events, minimum effective dose and the like, together with measurement of pharmacokinetic parameters that establish the determined or derived circulating blood levels. The results can then be correlated with the dose administered and the blood concentrations of the therapeutic that are coincident with the foregoing determined parameters or effect levels. By these methods, a range of doses and blood concentrations can be correlated to the minimum effective dose as well as the maximum dose and blood concentration at which a desired effect occurs or is maintained and the period for which it can be maintained, thereby establishing the therapeutic blood levels and dosing schedule for the composition. Thus, by the foregoing methods, a $C_{min}$ blood level is established, below which the CFXTEN fusion protein would not have the desired pharmacologic effect and a $C_{max}$ blood level, above which side effects such as thrombosis may occur (Brobrow, R S, JABFP (2005) 18(2):147-149), establishing the therapeutic window for the composition.

One of skill in the art can, by the means disclosed herein or by other methods known in the art, confirm that the administered CFXTEN remains at therapeutic blood levels to maintain hemostasis for the desired interval or requires adjustment in dose or length or sequence of XTEN. Further, the determination of the appropriate dose and dose frequency to keep the CFXTEN within the therapeutic window establishes the therapeutically effective dose regimen; the schedule for administration of multiple consecutive doses using a therapeutically effective dose of the fusion protein to a subject in need thereof resulting in consecutive $C_{max}$ peaks and/or $C_{min}$ troughs that remain above therapeutically-effective concentrations and result in an improvement in at least one measured parameter relevant for the target condition. In one embodiment, the CFXTEN or a pharmaceutical compositions comprising CFXTEN administered at an appropriate dose to a subject results in blood concentrations of the CFXTEN fusion protein that remains above the minimum effective concentration to maintain hemostasis for a period at least about two-fold longer compared to the corresponding FVIII not linked to XTEN and administered at a comparable dose; alternatively at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer, alternatively at least about ten-fold longer, or at least about twenty-fold longer or greater compared to the corresponding FVIII not linked to XTEN and administered at a comparable dose. As used herein, an "appropriate dose" means a dose of a drug or biologic that, when administered to a subject, would result in a desirable therapeutic or pharmacologic effect (e.g., hemostasis) and/or a blood concentration within the therapeutic window.

In practicing the invention, CFXTEN with longer terminal half-life are generally preferred, so as to improve patient convenience, to increase the interval between doses and to reduce the amount of drug required to achieve a sustained effect. The enhanced PK parameters allow for reduced dosing of the subject compositions, compared to FVIII not linked to XTEN, particularly for those hemophilia A subjects receiving routine prophylaxis.

As described more fully in the Examples pertaining to pharmacokinetic characteristics of fusion proteins comprising XTEN, it was observed that increasing the total length of the XTEN, singly or in combination, confers a disproportionate increase in the terminal half-life of a fusion protein comprising the XTEN. Accordingly, the invention provides CFXTEN fusion proteins and pharmaceutical compositions comprising CFXTEN wherein the CFXTEN exhibits an enhanced half-life when administered to a subject. In some embodiments, the invention provides monomeric CFXTEN fusion proteins comprising one or more XTEN wherein the number and location of the XTEN are selected to confer an increase in the terminal half-life for the CFXTEN administered to a subject compared to the corresponding FVIII not linked to the XTEN and administered at a comparable dose, wherein the increase is at least about two-fold longer, or at least about three-fold, or at least about four-fold, or at least about five-fold, or at least about six-fold, or at least about seven-fold, or at least about eight-fold, or at least about nine-fold, or at least about ten-fold, or at least about 15-fold, or at least a 20-fold, or at least a 40-fold or greater increase in terminal half-life compared to the FVIII not linked to the XTEN. In other embodiments, the invention provides CXTEN compositions and pharmaceutical compositions comprising CFXTEN wherein the administration of a composition to a subject in need thereof results in a terminal half-life that is at least 12 h greater, or at least about 24 h greater, or at least about 48 h greater, or at least about 96 h greater, or at least about 144 h greater, or at least about 7 days greater, or at least about 14 days greater, or at least about 21 days greater compared to a comparable dose of FVIII not linked to XTEN. In another embodiment, administration of a coagulation-effective dose of a CFXTEN fusion protein to a subject in need thereof can result in a gain in time between consecutive doses necessary to maintain blood levels of about 0.1 IU/ml of at least 48 h, or at least 72 h, or at least about 96 h, or at least about 120 h, or at least about 7 days, or at least about 14 days, or at least about 21 days between consecutive doses compared to a FVIII not linked to XTEN and administered at a comparable dose.

In one embodiment, the present invention provides CFXTEN fusion proteins and pharmaceutical compositions comprising CFXTEN that exhibit, when administered to a subject in need thereof, an increase in AUC of at least about 50%, or at least about 60%, or at least about 70%, or at least about 80%, or at least about 90%, or at least about a 100%, or at least about 150%, or at least about 200%, or at least about 300%, or at least about 500%, or at least about 1000%, or at least about a 2000% compared to the corresponding FVIII not linked to the XTEN and administered to a subject at a comparable dose. The pharmacokinetic parameters of a CFXTEN can be determined by standard methods involving dosing, the taking of blood samples at timed intervals, and the assaying of the protein using ELISA, HPLC, radioassay, clotting assays, the assays of Table 49, or other methods known in the art or as described herein, followed by standard calculations of the data to derive the half-life and other PK parameters.

In one embodiment, a smaller IU amount of about two-fold less, or about three-fold less, or about four-fold less, or about five-fold less, or about six-fold less, or about eight-fold less, or about 10-fold less or greater of the fusion protein is administered in comparison to the corresponding FVIII not linked to the XTEN under a dose regimen needed to maintain hemostasis and the fusion protein achieves a comparable area under the curve as the corresponding IU amount of the FVIII not linked to the XTEN needed to maintain hemostasis. In another embodiment, the CFXTEN fusion protein or a pharmaceutical compositions comprising CFXTEN requires less frequent administration for routine prophylaxis of a hemophilia A subject, wherein the dose of fusion protein is administered about every four days, about every seven days, about every 10 days, about every 14 days, about every 21 days, or about monthly to the subject, and the fusion protein achieves a comparable area under the curve as the corresponding FVIII not linked to the XTEN and administered to the subject. In yet other embodiments, an accumulative smaller IU amount of about 5%, or about 10%, or about 20%, or about 40%, or about 50%, or about 60%, or about 70%, or about 80%, or about 90% less of the fusion protein is administered to a subject in comparison to the corresponding IU amount of the FVIII not linked to the XTEN under a dose regimen needed to maintain a blood concentration of 0.1 IU/ml, yet the fusion protein achieves at least a comparable area under the curve as the corresponding FVIII not linked to the XTEN. The accumulative smaller IU amount is measure for a period of at least about one week, or about 14 days, or about 21 days, or about one month.

In one aspect, the invention provides CFXTEN compositions designed to reduce binding by FVIII binding agents, thereby increasing the terminal half-life of CFXTEN administered to a subject, while still retaining procoagulant activity. It is believed that the CFXTEN of the present invention have comparatively higher and/or sustained activity achieved by reduced active clearance of the molecule by the addition of unstructured XTEN to the FVIII coagulation factor. The clearance mechanisms to remove FVIII from the circulation have yet to be fully elucidated. Uptake, elimination, and inactivation of coagulation proteins can occur in the circulatory system as well as in the extravascular space. Coagulation factors are complex proteins that interact with a large number of other proteins, lipids, and receptors, and many of these interactions can contribute to the elimination of CFs from the circulation. The protein von Willebrand factor is an example of a FVIII binding agent that binds to FVIII. Factor VIII and von Willebrand factor (VWF) circulate in the blood as a tight, non-covalently linked complex in which VWF serves as a carrier that likely contributes to the protection of FVIII from active cleavage mechanisms, yet nevertheless results in a limitation on the terminal half-life of FVIII. For example: (i) VWF stabilizes the heterodimeric structure of FVIII; (ii) VWF protects FVIII from proteolytic degradation by phospholipid-binding proteases like activated protein C and activated FX (FXa); (iii) VWF interferes with binding of FVIII to negatively charged phospholipid surfaces exposed within activated platelets; (iv) VWF inhibits binding of FVIII to activated FIX (FIXa), thereby denying FVIII access to the FX-activating complex; and (v) VWF prevents the cellular uptake of FVIII (Lenting, P. J., et al., J Thrombosis and Haemostasis (2007) 5(7):1353-1360). In addition, LDL receptor-related protein (LRP1, also known as $\alpha$2-macrogobulin receptor or CD91) has been identified as a candidate clearance receptor for FVIII, with LRP1 binding sites identified on both chains of the heterodimer form of FVIII (Lenting P J, et al., J Biol Chem (1999) 274: 23734-23739; Saenko E L, et al., J Biol Chem (1999) 274: 37685-37692). LRPs are involved in the clearance of a diversity of ligands including proteases, inhibitors of the Kunitz type, protease serpin complexes, lipases and lipoproteins (Narita, et al., Blood (1998) 2:555-560). It has been shown that the light chain, but not the heavy chain, of factor VIII binds to surface-exposed LRP1 receptor protein (Lentig et al. (J Biol Chem (1999) 274(34):23734-23739; and U.S. Pat. No. 6,919,311), which suggests that LRP1 may play an essential role in the active clearance of proteins like FVIII. While the VWF-FVIII interaction is of high affinity (<1 nM), the complex is nevertheless in a dynamic equilibrium, such that a small but significant portion of the FVIII molecules (5-8%) circulate as a free protein (Leyte A, et al., Biochem J (1989) 257: 679-683; Noe D A. Haemostasis (1996) 26: 289-303). As such, a portion of native FVIII is unprotected by VWF, allowing active clearance mechanisms to remove the unprotected FVIII from the circulation.

In one embodiment, the invention provides CFXTEN that associate with VWF but have enhanced protection from active clearance receptors conferred by the incorporation of two more XTEN at one or more locations within the FVIII molecule (e.g., locations selected from Table 5, Table 6, Table 7, Table 8, and Table 9 or FIGS. 8-9), wherein the XTEN interfere with the interaction of the resulting CFXTEN with those clearance receptors with the result that the pharmacokinetic properties of the CFXTEN is enhanced compared to the corresponding FVIII not linked to XTEN. In another embodiment, the invention provides CFXTEN that have reduced binding affinity with VWF of at least 5% less, or about 10%, or about 20%, or about 40%, or about 50%, or about 60%, or about 70% less, but are nevertheless configured to have enhanced protection from active clearance receptors conferred by the incorporation of XTEN at one or more locations within the FVIII molecule, wherein the XTEN interfere with the interaction of factor VIII with those receptors. In the foregoing embodiments, the CFXTEN have an increased terminal half-life of at least about 12 h, or 24 h, or 48 h, or 72 h, or 96 h, or 120 h, or 144 h, or 7 days, or 10 days, or 14 days, or 21 days compared to the FVIII not linked to XTEN. The invention provides a method to create CFXTEN with reduced clearance wherein the CFXTEN fusion proteins created with the multiple insertions are evaluated for inhibition of binding to clearance receptors, compared to FVIII not linked to XTEN, using in vitro binding assays or in vivo pharmacokinetic models described herein or other assays known in the art, and selecting those that demonstrate reduced binding yet retain procoagulant FVIII activity. In addition, the foregoing fusion proteins can be optimized to have increased Ratio XTEN Radii of at least 2.0-3.5 in order to achieve pharmacokinetic properties that are further enhanced. Table 5, Table 6, Table 7, Table 8, and Table 9 and FIGS. 8-9 provide non-limiting examples of XTEN insertion points within the factor VIII sequence. Using such insertion points, the invention contemplates CFXTEN compositions that have configurations with multiple XTEN inserted with about 100, or about 200, or about 300, or about 400, or about 500 amino acids separating at least three XTEN to further increase the protection against active clearance mechanisms and, hence, increase the terminal half-life of the CFXTEN. Not to be bound by a particular theory, the XTEN of the CFXTEN compositions with high net charge (e.g., CFXTEN comprising AE family XTEN) are expected, as described above, to have less non-specific interactions with various negatively-charged surfaces such as blood vessels, tissues, or various receptors, which would further contribute to reduced active clearance. Conversely, the XTEN of the CFXTEN compositions with a low (or no) net charge (e.g., CFXTEN comprising AG family XTEN) are expected to have a higher degree of interaction with surfaces that, while contributing to active clearance, can potentiate the activity of the associated coagulation factor, given the known contribution of cell (e.g., platelets) and vascular surfaces to the coagulation process and the intensity of activation of coagulation factors (Zhou, R., et al., Biomaterials (2005) 26(16):2965-2973; London, F., et al. Biochemistry (2000) 39(32):9850-9858). The invention, in part, takes advantage of the fact that certain ligands wherein reduced binding to a clearance receptor, either as a result of a decreased on-rate or an increased off-rate, may be effected by the obstruction of a receptor site by an inserted XTEN forming random coil, resulting in the reduced binding. The choice of the particular configuration of the CFXTEN fusion protein can be tested by methods disclosed herein to confirm those configurations that reduce the degree of binding to a clearance receptor such that a reduced rate of active clearance is achieved. In one embodiment, the CFXTEN comprises a FVIII-XTEN sequence that has one or more XTEN inserted at locations selected from Table 5, Table 6, Table 7, Table 8, and Table 9 or FIGS. 8-9 wherein the terminal half-life of the CFXTEN is increased at least about two-fold, or at least about three-fold, or at least about four-fold, or at least about five-fold, or at least about six-fold, or at least about eight-fold, or at least about ten-fold, or at least about twenty-fold compared to a FVIII not linked to an XTEN. In another embodiment, the CFXTEN comprises a FVIII-XTEN sequence that has a first and at least a second XTEN inserted at a first and second location selected from Table 5, Table 6, Table 7, Table 8, and Table 9 or FIGS. 8-9 wherein the terminal half-life of the CFXTEN is increased at least about two-fold, or at least about three-fold, or at least about four-fold, or at least about five-fold, or at least about six-fold, or at least about eight-fold, or at least about ten-fold, or at least about twenty-fold compared to a FVIII not linked to an XTEN. In yet another embodiment, the CFXTEN comprises a FVIII-XTEN sequence that incorporates multiple XTEN sequences using three of more XTEN insertion locations selected from Table 5, Table 6, Table 7, Table 8, and Table 9 or FIGS. 8-9 separated by about 100, or about 200, or about 300, or about 400, or about 500 amino acids, wherein the terminal half-life of the CFXTEN is increased at least about two-fold, or at least about three-fold, or at least about four-fold, or at least about five-fold, or at least about six-fold, or at least about eight-fold, or at least about ten-fold, or at least about twenty-fold compared to a FVIII not linked to an XTEN. In the foregoing embodiments hereinabove described in this paragraph, the XTEN incorporated into the CFXTEN configurations can be identical or they can be different, and can have at least about 80%, or 90%, or 91%, or 92%, or 93%, or 94%, or 95%, or 96%, or 97%, or 98%, or 99%, sequence identity to a sequence from any one of Tables 3, 4, and 13-17, and can optionally include one or more cleavage sequences from Table 12, facilitating release of one or more of the XTEN from the CFXTEN fusion protein.

In one embodiment, the invention provides CFXTEN that enhance the pharmacokinetics of the fusion protein by linking one or more XTEN to the FVIII component of the fusion protein wherein the fusion protein has an increase in apparent molecular weight factor of at least about two-fold, or at least about three-fold, or at least about four-fold, or at least about five-fold, or at least about six-fold, or at least about seven-fold, or at least about eight-fold, or at least about ten-fold, or at least about twelve-fold, or at least about fifteen-fold, and wherein the terminal half-life of the CFXTEN when administered to a subject is increased at least about two-fold, or at least about four-fold, or at least about eight-fold, or at least about 10-fold or more compared to the corresponding FVIII not linked to XTEN. In the foregoing embodiment, wherein at least two XTEN molecules are incorporated into the CFXTEN, the XTEN can be identical or they can be of a different sequence composition, net charge, or length. The XTEN can have at least about 80%, or 90%, or 91%, or 92%, or 93%, or 94%, or 95%, or 96%, or 97%, or 98%, or 99%, sequence identity to a sequence from any one of Tables 3, 4, and 13-17, and can optionally include one or more cleavage sequences from Table 12, facilitating release of one or more of the XTEN from the CFXTEN fusion protein.

Thus, the invention provides CFXTEN compositions in which the degree of activity, bioavailability, half-life or physicochemical characteristic of the fusion protein can be tailored by the selection and placement of the type and length of the XTEN in the CFXTEN compositions. Accordingly, the invention contemplates compositions in which a FVIII from Table 1 and XTEN or XTEN fragment from any one of Tables 3, 4, or 13-17 are produced, for example, in a configuration selected from any one of formulae I-VIII or the XTEN are inserted at locations selected from Table 5, Table 6, Table 7, Table 8, and Table 9 or FIGS. 8-9 such that the construct has the desired property.

The invention provides methods to produce the CFXTEN compositions that can maintain the FVIII component at therapeutic levels in a subject in need thereof for at least a two-fold, or at least a three-fold, or at least a four-fold, or at least a five-fold greater period of time compared to comparable dosages of the corresponding FVIII not linked to XTEN. In one embodiment of the method, the subject is receiving routine prophylaxis to prevent bleeding episodes. In another embodiment of the method, the subject is receiving treatment for a bleeding episode. In another embodiment of the method, the subject is receiving treatment to raise the circulating blood concentration of procoagulant FVIII above 1%, or above 1-5%, or above 5-40% relative to FVIII concentrations in normal plasma. "Procoagulant" as used herein has its general meaning in the art and generally refers to an activity that promotes clot formation, either in an in vitro assay or in vivo. The method to produce the compositions that can maintain the FVIII component at therapeutic levels includes the steps of selecting one or more XTEN appropriate for conjugation to a FVIII to provide the desired pharmacokinetic properties in view of a given dose and dose regimen, creating a gene construct that encodes the CFXTEN in one of the configurations disclosed herein, transforming an appropriate host cell with an expression vector comprising the encoding gene, expressing the fusion protein under suitable culture conditions, recovering the CFXTEN, administration of the CFXTEN to a mammal followed by assays to verify the pharmacokinetic properties and the activity of the CFXTEN fusion protein (e.g., the ability to maintain hemostasis or serve as a procoagulant) and the safety of the administered composition. Those compositions exhibiting the desired properties are selected for further use. CFXTEN created by the methods provided herein can result in increased efficacy of the administered composition by, amongst other properties, maintaining the circulating concentrations of the procoagulant FVIII component at therapeutic levels for an enhanced period of time.

The invention provides methods to assay the CFXTEN fusion proteins of differing composition or configuration in order to provide CFXTEN with the desired degree of procoagulant and therapeutic activity and pharmacokinetic properties, as well as a sufficient safety profile. Specific in vitro and in vivo assays or animal models are used to assess the activity and functional characteristics of each configured CFXTEN and/or FVIII component to be incorporated into CFXTEN, including but not limited to the assays of the Examples, those assays of Table 49, as well as the following assays or other such assays known in the art for assaying the properties and effects of FVIII. Functional assays can be conducted that allow determination of coagulation activity, such as one-stage clotting assay and two-stage clotting assay (Barrowcliffe T W, Semin Thromb Hemost. (2002) 28(3): 247-256), activated partial prothrombin (aPTT) assays (Belaaouaj A A et al., J. Biol. Chem. (2000) 275:27123-8; Diaz-Collier J A. Haemost (1994) 71:339-46), chromogenic FVIII assays (Lethagen, S., et al., Scandinavian J Haematology (1986) 37:448-453), or animal model pharmacodynamic assays including bleeding time or thrombelastography (TEG or ROTEM), among others. Other assays include determining the binding affinity of a CFXTEN for the target substrate using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. Other assays to determine the binding of FVIII inhibitors to CFXTEN include the Bethesda assay or the Nijmegen modification of the Bethesda assay. The foregoing assays can also be used to assess FVIII sequence variants (assayed as single components or as CFXTEN fusion proteins) and can be compared to the native FVIII to determine whether they have the same degree of procoagulant activity as the native CF, or some fraction thereof such that they are suitable for inclusion in CFXTEN; e.g., at least about 10%, or at least about 20$, or about 30%, or at least about 40%, or at least about 50%, or at least about 60%, or at least about 70%, or at least about 80%, or at least about 90% of the activity compared to the native FVIII.

Dose optimization is important for all drugs. A therapeutically effective dose or amount of the CFXTEN varies according to factors such as the disease state, age, sex, and weight of the individual, and the ability of the administered fusion protein to elicit a desired response in the individual. For example, a standardized single dose of FVIII for all patients presenting with diverse bleeding conditions or abnormal clinical parameters (e.g., neutralizing antibodies) may not always be effective. Hemophilia A patients with trauma, who have undergone surgery, or that have high titers of FVIII inhibitory antibodies generally will require higher and more frequent dosing. Generally, dosage level is adjusted in frequency, duration, and units in keeping with the severity and duration of each patient's bleeding episode. Accordingly, the CFXTEN is included in the pharmaceutically acceptable carrier, delivery vehicle, or stabilizer in an amount sufficient to deliver to a patient a therapeutically effective amount of the fusion protein to stop bleeding, as measured by standard clotting assays. A consideration of these factors is well within the purview of the ordinarily skilled clinician for the purpose of determining the therapeutically or pharmacologically effective amount of the CFXTEN and the appropriated dosing schedule, versus that amount that would result in insufficient potency such that clinical improvement or the arrest of bleeding is not achieved.

The invention provides methods to establish a dose regimen for the CFXTEN pharmaceutical compositions of the invention. The methods include administration of consecutive doses of a therapeutically effective amount of the CFXTEN pharmaceutical composition using variable periods of time between doses to determine that interval of dosing sufficient to achieve and/or maintain the desired parameter, blood level or clinical effect; such consecutive doses of a therapeutically effective amount at the effective interval establishes the therapeutically effective dose regimen for the CFXTEN for a factor VIII-related disease state or condition. A prophylactically effective amount refers to an amount of CFXTEN required for the period of time necessary to prevent a physiologic or clinical result or event; e.g., delayed onset of a bleeding episode or maintaining blood concentrations of procoagulant FVIII or equivalent above a threshold level (e.g., 1-5% to 5-40% of normal). In the methods of treatment, the dosage amount of the CFXTEN that is administered to a subject ranges from about 5 to 300 IU/kg/dose, or from about 10 to 100 IU/kg/dose, or from about 20 to about 65 IU/kg/dose, or from about 20 to about 40 IU/kg/dose for a subject. A suitable dosage may also depend on other factors that may influence the response to the drug; e.g., bleeding episodes generally requiring higher doses at more frequent intervals compared to prophylaxis.

In some embodiments, the method comprises administering a therapeutically-effective amount of a pharmaceutical composition comprising a CFXTEN fusion protein composition and at least one pharmaceutically acceptable carrier to a subject in need thereof, wherein the administration results in a greater improvement in at least one parameter or physiologic condition associated with a FVIII deficiency or coagulopathy, or results in a more favorable clinical outcome mediated by the FVIII component of the CFXTEN compared to the effect on the parameter, condition or clinical outcome mediated by administration of a pharmaceutical composition comprising a FVIII not linked to XTEN and administered at a comparable dose. Non-limiting examples of parameters that are improved include blood concentration of procoagulant FVIII, a reduced activated partial prothrombin (aPTT) assay time, a reduced one-stage or two-stage clotting assay time, delayed onset of a bleeding episode, a reduced chromogenic FVIII assay time, a reduced bleeding time, resolution of a bleeding event, or a reduced Bethesda titer to the CFXTEN relative to native FVIII. In one embodiment of the foregoing, the improvement is achieved by administration of the CFXTEN pharmaceutical composition at a dose that achieves a circulating concentration of procoagulant FVIII (or equivalent) above a threshold level (e.g., 1-5% to 5-40% of normal FVIII levels), thereby establishing the therapeutically effective dose. In another embodiment of the foregoing, the improvement is achieved by administration of multiple consecutive doses of the CFXTEN pharmaceutical composition using a therapeutically effective dose regimen that maintains a circulating concentration of procoagulant FVIII (or equivalent) above a threshold level (e.g., 1-5% to 5-40% of normal FVIII levels) for the length of the dosing period. In another embodiment of the method, the administration of at least two consecutive doses of the CFXTEN pharmaceutical composition using a therapeutically effective dose regimen maintains a circulating concentration of procoagulant FVIII (or equivalent) above about 1%, 2%, 3%, 4%, 5%, 10%, 15%, 20%, 30%, or 40% of normal FVIII levels for a period that is at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer compared to a FVIII not linked to XTEN and administered using a therapeutically effective dose regimen In one embodiment, the CFXTEN or a pharmaceutical compositions comprising CFXTEN administered at a therapeutically effective dose regimen results in a gain in time of at least about three-fold longer; alternatively at least about four-fold longer; alternatively at least about five-fold longer; alternatively at least about six-fold longer; alternatively at least about seven-fold longer; alternatively at least about eight-fold longer; alternatively at least about nine-fold longer or at least about ten-fold longer between at least two consecutive $C_{max}$ peaks and/or $C_{min}$ troughs for blood levels of the fusion protein compared to the corresponding biologically active protein of the fusion protein not linked to the XTEN and administered at a comparable dose regimen to a subject. In another embodiment, the CFXTEN administered at a therapeutically effective dose regimen results in a comparable improvement in one, or two, or three or more measured parameters using less frequent dosing or a lower total dosage in IUs of the fusion protein of the pharmaceutical composition compared to the corresponding biologically active protein component(s) not linked to the XTEN and administered to a subject using a therapeutically effective dose regimen for the FVIII. The measured parameters include any of the clinical, biochemical, or physiological parameters disclosed herein, or others known in the art for assessing subjects with factor VIII-related conditions.

(b) Pharmacology and Pharmaceutical Properties of CFXTEN

The present invention provides CFXTEN compositions comprising FVIII covalently linked to XTEN that have enhanced pharmaceutical and pharmacology properties compared to FVIII not linked to XTEN, as well as methods to enhance the therapeutic and/or procoagulant effect of the FVIII components of the compositions. In addition, the invention provides CFXTEN compositions with enhanced properties compared to those art-known fusion proteins of factor VIII containing albumin, immunoglobulin polypeptide partners, polypeptides of shorter length and/or polypeptide partners with repetitive sequences. In addition, CFXTEN fusion proteins provide significant advantages over chemical conjugates, such as pegylated constructs of FVIII, notably the fact that recombinant CFXTEN fusion proteins can be made in host cell expression systems, which can reduce time and cost at both the research and development and manufacturing stages of a product, as well as result in a more homogeneous, defined product with less toxicity from both the product and metabolites of the CFXTEN compared to pegylated conjugates.

As therapeutic agents, the CFXTEN possesses a number of advantages over therapeutics not comprising XTEN, including one or more of the following non-limiting properties: increased solubility, increased thermal stability, reduced immunogenicity, increased apparent molecular weight, reduced renal clearance, reduced proteolysis, reduced metabolism, enhanced therapeutic efficiency, less frequent dosage regimen with increased time between doses capable of maintaining hemostasis in a subject with hemophilia A, the ability to administer the CFXTEN composition subcutaneously or intramuscularly, a "tailored" rate of absorption when administered subcutaneously or intramuscularly, enhanced lyophilization stability, enhanced serum/plasma stability, increased terminal half-life, increased solubility in blood stream, decreased binding by neutralizing antibodies, decreased active clearance, tailored substrate binding affinity, stability to degradation, stability to freeze-thaw, stability to proteases, stability to ubiquitination, ease of administration, compatibility with other pharmaceutical excipients or carriers, persistence in the subject, increased stability in storage (e.g., increased shelf-life), and the like. The net effect of the enhanced properties is that the use of a CFXTEN composition can result in an overall enhanced therapeutic effect compared to a FVIII not linked to XTEN, result in economic benefits associated with less frequent dosing, and/or result in improved patient compliance when administered to a subject with a factor VIII-related condition.

The invention provides CFXTEN compositions and pharmaceutical compositions comprising CFXTEN wherein the administration of the composition results in an improvement in at least one of the clinical or biochemical parameters disclosed herein as being useful for assessing the subject diseases, conditions or disorders. Non-limiting examples of parameters that are improved include blood concentrations of procoagulant FVIII, a reduced activated partial prothrombin (aPTT) assay time, a reduced one-stage or two-stage clotting assay time, delayed onset of a bleeding episode, a reduced chromogenic FVIII assay time, a reduced bleeding time, resolution of a bleeding event, or a reduced Bethesda titer to the CFXTEN relative to native FVIII. The enhanced pharmacokinetic properties of the subject CFXTEN permits using an accumulatively lower IU dose of fusion protein to maintain the parameter compared to the corresponding FVIII component not linked to the XTEN. In one embodiment, the total dose in IUs of an CFXTEN of the embodiments needed to achieve and maintain the improvement in the at least one parameter for about 2-7 days is at least about three-fold lower, or at least about four-fold, or at least about five-fold, or at least about six-fold, or at least about eight-fold, or at least about 10-fold lower compared to the corresponding FVIII component not linked to the XTEN. In another embodiment, the total dose in IUs of a subject CFXTEN needed to achieve and maintain the improvement in the at least one parameter over two, three or four consecutive doses is at least about three-fold lower, or at least about four-fold, or at least about five-fold, or at least about six-fold, or at least about eight-fold, or at least about 10-fold lower compared to the corresponding FVIII component not linked to the XTEN. Alternatively, the invention provides certain embodiments of CFXTEN wherein the period between consecutive administrations that results in achieving and maintaining the improvement in at least one parameter is at least about three-fold, or at least about four-fold, or at least about five-fold, or at least about six-fold, or at least about eight-fold, or at least about 10-fold longer compared to the corresponding FVIII component not linked to the XTEN and administered at a comparable IU dose. Alternatively, the invention provides certain embodiments of CFXTEN wherein administration of 25 IU/kg results in a 30% improvement in a aPTT assay (or similar coagulation assay) time in a hemophilia A subject compared to 25 IU/kg of the corresponding FVIII not linked to XTEN when assayed at about 2-7 days after administration. In yet another embodiment, the invention provides CFXTEN wherein administration of 25 IU/kg results in a 30% improvement in a bleeding time assay time in a hemophilia A subject compared to 25 IU/kg of the corresponding FVIII not linked to XTEN when assayed at about 2-7 days after administration.

In one embodiment, XTEN as a fusion partner increases the solubility of the FVIII payload. Accordingly, where enhancement of the pharmaceutical or physicochemical properties of the FVIII is desirable, such as the degree of aqueous solubility or stability, the length and/or the motif family composition of the XTEN sequences incorporated into the fusion protein may each be selected to confer a different degree of solubility and/or stability on the respective fusion proteins such that the overall pharmaceutical properties of the CFXTEN composition are enhanced. The CFXTEN fusion proteins can be constructed and assayed, using methods described herein, to confirm the physicochemical properties and the choice of the XTEN length sequence or location adjusted, as needed, to result in the desired properties. In one embodiment, the CFXTEN has an aqueous solubility that is at least about 25% greater compared to a FVIII not linked to the XTEN, or at least about 30%, or at least about 40%, or at least about 50%, or at least about 75%, or at least about 100%, or at least about 200%, or at least about 300%, or at least about 400%, or at least about 500%, or at least about 1000% greater than the corresponding FVIII not linked to XTEN.

The invention provides methods to produce and recover expressed CFXTEN from a host cell with enhanced solubility and ease of recovery compared to FVIII not linked to XTEN. In one embodiment, the method includes the steps of transforming a eukaryotic host cell with a polynucleotide encoding a CFXTEN with one or more XTEN components of cumulative sequence length greater than about 100, or greater than about 200, or greater than about 400, or greater than about 600, or greater than about 800, or greater than about 1000, or greater than about 2000, or greater than about 3000 amino acid residues, expressing the CFXTEN fusion protein in the host cell under suitable culture and induction conditions, and recovering the expressed fusion protein in soluble form. In one embodiment, the one or more XTEN of the CFXTEN fusion proteins each have at least about 80% sequence identity, or about 90%, or about 91%, or about 92%, or about 93%, or about 94%, or about 95%, or about 96%, or about 97%, or about 98%, or about 99%, to about 100% sequence identity compared to one or more XTEN selected from any one of Tables 4, and 13-17, or fragments thereof, and the FVIII have at least about 80% sequence identity, or about 90%, or about 91%, or about 92%, or about 93%, or about 94%, or about 95%, or about 96%, or about 97%, or about 98%, or about 99%, or 100% sequence identity compared to a FVIII selected from Table 1, and the CFXTEN components are in an N- to C-terminus configuration selected from any one of the configuration embodiments disclosed herein.

VI). Uses of the CFXTEN Compositions

The invention provides methods and regimens for achieving a beneficial effect in a factor VIII-related condition by the administration of compositions comprising CFXTEN. As used herein, "factor VIII-related condition" is intended to include, but is not limited to factor VIII deficiencies, bleeding disorders related to factor VIII deficiency, hemophilia A, neutralization of factor VIII by anti-FVIII antibodies or other factor VIII inhibitors, and bleeding episodes resulting from trauma or surgery or vascular injury and other such conditions that can be ameliorated or corrected by administration of FVIII to a subject. The inventive methods achieve a beneficial effect while addressing disadvantages and/or limitations of other methods of treatment using factor VIII preparations that have a relatively short terminal half-life, require frequent administrations, are neutralized by inhibitors or have unfavorable pharmacoeconomics.

Hemostasis is regulated by multiple protein factors, and such proteins, as well as analogues thereof, have found utility in the treatment of factor VIII-related conditions. However, the use of commercially-available FVIII has met with less than optimal success in the management of subjects afflicted with such conditions. In particular, dose optimization and frequency of dosing is important for FVIII used in maintaining circulating FVIII concentrations above threshold levels needed for hemostasis, as well as the treatment or prevention of bleeding episodes in hemophilia A subjects. The fact that commercially-available FVIII products have a short half-life necessitates frequent dosing in order to achieve clinical benefit, which results in difficulties in the management of such patients.

As established by the Subcommittee on Factor VIII and Factor IX of the Scientific and Standardization Committee of the International Society on Thrombosis and Haemostasis (posted on the ISTH Website 29 Nov. 2000), the most widely used measure of the severity of hemophilia A is established by determining the circulating concentrations of plasma FVIII procoagulant levels, with persons with <1% (<0.01 IU/ml) factor VIII defined as severe; 1-5% (0.01-0.05 IU/ml) as moderately severe; and >5-40% (0.05-<0.40 IU/ml) as mild, where normal is 1 IU/ml of factor VIIIC (100%).

The invention provides methods of treating a subject suffering from or at risk of developing a factor VIII-related condition. More particularly, the invention provides methods for treating or preventing controlling bleeding in subject. The subject can be any animal but preferably is a human. In one embodiment, the method comprises administering a coagulation-effective amount of a CFXTEN composition to the subject in need thereof. In another embodiment, the method comprises the step of administering to the subject with a bleed a coagulation-effective amount of a pharmaceutical composition that includes a CFXTEN, wherein the administration results in an arrest or attenuation of the bleeding. As used herein, "coagulation-effective amount" is an amount of a FVIII composition that, when administered to a subject, is sufficient to effect hemostasis or other beneficial or desired therapeutic (including preventative) result. In practicing the present invention, it will be understood that a coagulation-effective amount can be administered in one or more administrations. Precise coagulation-effective amounts of the pharmaceutical composition to be administered will be guided by the judgment of the practitioner, however, the unit dose will generally depend on the severity or cause of the bleeding and the amount of pre-existing FVIII in the subject. In a particular embodiment of the method of treating a bleed, a coagulation-effective amount of a pharmaceutical compositions comprising CFXTEN is administered to a subject suffering from a bleeding episode, wherein the administration results in the resolution of the bleeding for a duration at least two-fold, or at least three-fold, or at least four-fold longer compared to a FVIII not linked to XTEN and administered to a comparable subject with a comparable bleed at a comparable dose.

In another embodiment, the administration of a coagulation-effective amount of a CFXTEN composition to a subject with a factor VIII-related condition results in a 10%, or 20%, or 30%, or 40%, or 50%, or 60%, or 70% or greater improvement of one or more biochemical, physiological or clinical parameters associated with the FVIII condition, compared to the FVIII not linked to XTEN, when measured at between 2 and 7 days after administration. In another embodiment, the administration of a coagulation-effective amount of a CFXTEN composition to the subject in need thereof results in an improvement of one or more biochemical, physiological or clinical parameters associated with the FVIII condition for a period at least two-fold longer, or at least four-fold longer, or at least five-fold longer, or at least six-fold longer compared to period achieved by a FVIII not linked to XTEN and administered at a comparable dose. Non-limiting examples of parameters that are improved for a longer duration include blood concentrations of procoagulant FVIII, a reduced activated partial prothrombin (aPTT) assay time, a reduced one-stage or two-stage clotting assay time, delayed onset of a bleeding episode, a reduced chromogenic FVIII assay time, a reduced bleeding time, among other FVIII-related parameters known in the art. In the foregoing embodiments of the paragraph, the administered CFXTEN comprises a FVIII with at least about 80%, or at least about 90%, or at least about 95%, or at least about 97%, or at least about 99% sequence identity to a factor VIII of Table 1 and one or more XTEN sequences with at least about 80%, or at least about 90%, or at least about 95%, or at least about 97%, or at least about 99% sequence identity to an XTEN of Table 4 inserted into the FVIII at one or more locations selected from Table 5, Table 6, Table 7, Table 8, and Table 9, or as depicted in FIGS. 8-9. In certain embodiments, at least one XTEN insertion site of the CFXTEN is selected from amino acids 32, 220, 224, 336, 339, 390, 399, 416, 603, 1656, 1711, 1725, 1905 and 1910 (numbered relative to mature native human FVIII).

In a particular embodiment of the method of treatment, a coagulation-effective amount of CFXTEN fusion protein administered to a subject suffering from hemophilia A is sufficient to increase the circulating FVIII procoagulant concentration to greater than 0.05 IU/ml and to maintain hemostasis for at least about 24 h, or at least about 48 h, or at least about 72 h, or at least about 96 h, or at least about 120 h, or at least about 144 h, or at least about 168 h, or greater. In another embodiment, the administration of a coagulation-effective amount of a pharmaceutical composition comprising CFXTEN to a subject in need thereof results in a greater reduction in a one-stage clotting assay time of at least about 5%, or about 10%, or about 20%, or about 30%, or about 40%, or about 50%, or about 60%, or about 70%, or more in a blood sample from the subject at 2-7 days after the administration compared to the assay time in a subject after administration of a comparable amount of the corresponding FVIII not linked to XTEN. In another embodiment, the administration of a therapeutically effective amount of a CFXTEN or a pharmaceutical compositions comprising CFXTEN to a subject in need thereof results in a greater reduction in the activated partial prothrombin time of at least about 5%, or about 10%, or about 20%, or about 30%, or about 40%, or about 50%, or about 60%, or about 70%, or more in a blood sample from the subject 2-7 days after administration compared to the activated partial prothrombin time in a subject after administration of a comparable amount of the corresponding FVIII not linked to XTEN. In another embodiment, the administration of a CFXTEN or a pharmaceutical compositions comprising CFXTEN to a subject in need thereof using a therapeutically effective amount results in maintenance of activated partial prothrombin times within 30% of normal in a blood sample from the subject for a period of time that is at least two-fold, or at least about three-fold, or at least about four-fold longer compared to that of a FVIII not linked to XTEN and administered to a subject using a comparable dose.

In one embodiment of the method of treatment, the CFXTEN fusion protein is formulated and administered as a pharmaceutical composition comprising the CFXTEN in admixture with a pharmaceutically acceptable excipient. Methods for making pharmaceutical formulations are well known in the art. Techniques and formulations generally may be found in Remington's Pharmaceutical Sciences, 18th Edition, Mack Publishing Co., Easton, Pa. 1990 (See, also, Wang and Hanson, Parenteral Formulations of Proteins and Peptides: Stability and Stabilizers, Journal of Parenteral Science and Technology, Technical Report No. 10, Supp. 42-2S (1988)).

In another aspect, the invention provides a regimen for treating a hemophilia A patient, said regimen comprising a composition comprising a CFXTEN fusion protein. In one embodiment of the regimen for treating a hemophilia A patient, the regimen further comprises the step of determining the amount of pharmaceutical composition comprising the CFXTEN needed to achieve hemostasis in the patient. In some embodiments of the regimen, (i) a smaller IU amount of about two-fold less, or about three-fold less, or about four-fold less, or about five-fold less, or about six-fold less, or about eight-fold less, or about 10-fold less of the pharmaceutical composition comprising CFXTEN is administered to a subject in need thereof in comparison to the corresponding coagulation factor not linked to the XTEN under an otherwise same dose regimen, and the fusion protein achieves a comparable area under the curve (based on IU/ml) and/or a comparable therapeutic effect as the corresponding FVIII not linked to the XTEN; (ii) the pharmaceutical composition is administered less frequently (e.g., every three days, about every seven days, about every 10 days, about every 14 days, about every 21 days, or about monthly) in comparison to the corresponding FVIII not linked to the XTEN under an otherwise same dose amount, and the fusion protein achieves a comparable area under the curve and/or a comparable therapeutic effect as the corresponding coagulation factor not linked to the XTEN; or (iii) an accumulative smaller IU amount of at least about 20%, or about 30%, or about 40%, or about 50%, or about 60%, or about 70%, or about 80%, or about 90% less of the pharmaceutical composition is administered in comparison to the corresponding FVIII not linked to the XTEN under an otherwise same dose schedule and the CFXTEN fusion protein achieves a comparable therapeutic effect as the corresponding FVIII not linked to the XTEN. The accumulative smaller IU amount is measured for a period of at least about one week, or about 14 days, or about 21 days, or about one month. In the foregoing embodiments, the therapeutic effect can be determined by any of the measured parameters described herein, including but not limited to blood concentration of procoagulant FVIII, a reduced activated partial prothrombin (aPTT) assay time, a reduced one-stage or two-stage clotting assay time, delayed onset of a bleeding episode, a reduced chromogenic FVIII assay time, a reduced bleeding time, resolution of a bleeding event, or a reduced Bethesda titer to the CFXTEN relative to native FVIII, fibrinogen levels, or other assays known in the art for assessing coagulopathies of FVIII. In another embodiment, the invention provides CFXTEN for use in a regimen for a treating a hemophilia A subject comprising administering an CFXTEN composition in two or more successive doses to the subject at an effective amount, wherein the administration results in at least a 10%, or 20%, or 30%, or 40%, or 50%, or 60%, or 70%, or 80%, or 90% greater improvement of at least one, two, or three parameters associated with the disease compared to a FVIII not linked to XTEN and administered using a comparable dose.

In one aspect, the present invention relates to a method of preventing or treating the bleeding in a patient, optionally a haemophilia A patient, having pre-existing inhibitor(s) against FVIII. Inhibitory antibodies against FVIII commonly develop in hemophiliacs, where the overall incidence of developing an inhibitor is 15-30%, particularly in haemophiliacs who are heavily exposed to FVIII concentrates (Algiman et al. Natural antibodies to factor VIII (anti-hemophilic factor) in healthy individuals. PNAS USA (1992) 89: 3795-3799). However, inhibitory antibodies also occur in patients in auto-immune disorders, malignancies (such as lymphoproliferative disorders, lymphomas and solid tumors), during pregnancy and in the post-partum state. Inhibition can also occur when antibodies interfere with the binding of FVIII to FIX and FX. Simultaneously or alternatively, anti-FVIII antibodies can interfere with the binding of von Willebrand factor and/or phospholipids to FVIII, affecting coagulation and/or half-life of FVIII. The presence of inhibitory antibodies is often first detected with symptoms such as easy bruising and uncontrolled bleeding, and is usually referred to as acquired hemophilia. Anti-FVIII antibodies can be determined by different methods including quantitation of anti-FVIII activity in coagulation assays, ELISA for FVIII inhibitors and purification using chromatography and immunoadsorption (Algiman et al., 1992). Accordingly, the inventive methods are used in the treatment or prevention of any condition associated with or characterized by the presence of inhibitory antibodies to FVIII. In one embodiment, the invention provides a method of treating a patient having a pre-existing inhibitor against FVIII, the method comprising the step of administering to the patient a coagulation-effective amount of a CFXTEN fusion protein that must be administered to achieve hemostasis, wherein the coagulation-effective amount of fusion protein administered is reduced in comparison to the amount of FVIII not linked to XTEN (or native FVIII) that must be administered to achieve hemostasis. In the method, the reduced amount of CFXTEN is about two-fold, or three-fold, or four-fold, or five-fold less in IU/kg compared to the corresponding FVIII not linked to XTEN. In another embodiment of the method, the amount of CFXTEN that is administered as a dose to achieve hemostasis is at least 20 to 40 IU/kg less, or 30 to 60 IU/kg less, or 40 to 80 IU/kg less, or 60 to 100 IU/kg less, or 100 to 140 IU/kg less, or 120 to 180 IU/kg less, or 140 to 200 IU/kg less compared to the corresponding FVIII not linked to XTEN or to native FVIII required to achieve hemostasis. In another embodiment, the invention provides a method of treating a bleeding episode in a hemophilia A subject having a titer of at least 10, or 20, or 30, or 40, or 50, or 75, or 100, or 150, or 200 or more Bethesda units against a FVIII not linked to XTEN, wherein the dose of CFXTEN fusion protein required to arrest the bleeding epidose is at least two-fold, or three-fold, or four-fold, or five-fold, or six-fold, or seven-fold, or eight-fold, or nine-fold, or 10-fold less in comparison to the amount of FVIII not linked to XTEN (or native FVIII) that must be administered to achieve hemostasis in a comparable subject. It will be understood by one of skill in the art that the amount of procoagulant administered to maintain hemostasis will depend on the severity of FVIII deficiency and/or the frequency or duration of bleeding.

A particular object of the present invention relates to use of CFXTEN with reduced binding by FVIII inhibitors that bind the A2 and/or C2 domains of Factor VIII as a drug. Such a drug is advantageously used for maintaining hemostasis in a patient suffering from haemophilia, wherein such patient has circulating FVIII inhibitors directed against the A2 domain and/or C2 domain of Factor VIII. In one embodiment, the invention provides a method of treatment, the method comprising the step of administering to the patient with a A2 domain-binding inhibitor a coagulation-effective amount of a CFXTEN fusion protein, wherein the CFXTEN exhibits at least 10%, or 20%, or 30%, or 40%, or 50%, or 60%, or 70%, or 80% or less binding to an inhibitor that binds the A2 domain of FVIII, compared to the FVIII not linked to XTEN or to native FVIII, and wherein the administration results in hemostasis. In another embodiment, the invention provides a method of treatment, the method comprising the step of administering to the patient with a C2 domain-binding inhibitor a coagulation-effective amount of a CFXTEN fusion protein, wherein the CFXTEN exhibits at least 10%, or 20%, or 30%, or 40%, or 50%, or 60%, or 70%, or 80% or less binding to an inhibitor that binds the C2 domain of FVIII, compared to the FVIII not linked to XTEN or to native FVIII, and wherein the administration results in hemostasis. The reduced binding of the subject CFXTEN can be assayed directly by ELISA that detects FVIII inhibitors, or measured indirectly by demonstration of reduced inhibition of FVIII activity of the CFXTEN compared to native FVIII in the presence of an inhibitor as measured by a factor VIII chromogenic test or one-step assay as described herein, or other suitable coagulation methods known in the art. Alternatively, the subject CFXTEN can be measured for reduced (or absence of) inhibition in the presence of known inhibitors by use of a modified Bethesda assay. According to a particular aspect of the present invention, a CFXTEN useful in the methods has reduced reactivity to one or more antibodies from Table 10, as well as naturally-occurring antibodies found in hemophilia patients. For testing purposes, such and other inhibitory antibodies can be obtained from humans (i.e. from the serum of patients which have inhibitory antibodies) or can be obtained from mice, guinea pigs, horses, goats, non-human primates and other mammals by immunization with FVIII, or fragments thereof, more particularly with a fragment comprising the all or part of the A2 or C2 domain, whether in polyclonal or monoclonal form.

The invention further contemplates that the CFXTEN used in accordance with the methods provided herein can be administered in conjunction with other treatment methods and compositions (e.g., other coagulation proteins) useful for treating factor VIII-related conditions, or conditions for which coagulation factor is adjunctive therapy; e.g., bleeding episodes due to injury or surgery. In another aspect, the invention provides methods of preparing a drug for a factor VIII-related condition, comprising combining a factor VIII sequence selected from Table 1 with one or more XTEN selected from Table 4 inserted in one or more insertion sites selected from Table 5, Table 6, Table 7, Table 8, and Table 9 to result in a drug that retains at least a portion of the activity of the native FVIII. The invention provides a method of preparing a pharmaceutical composition, comprising the step of combining the drug of the foregoing embodiment with at least one pharmaceutically acceptable carrier. In one embodiment of the method of preparing a drug for a factor VIII-related condition, the factor VIII has a sequence with at least about 80%, or at least about 90%, or at least about 95%, or at least about 97%, or at least about 99% sequence identity compared to a sequence selected from Table 1 and the one or more XTEN has a sequence with at least about 80%, or at least about 90%, or at least about 95%, or at least about 97%, or at least about 99% sequence identity compared to a sequence selected from any one of Tables 3, 4, and 13-17, or a fragment thereof, wherein the one or more XTEN are inserted in one or more locations selected from Table 5, Table 6, Table 7, Table 8, and Table 9. In a particular embodiment of the foregoing, at least one XTEN insertion site is selected from amino acids 32, 220, 224, 336, 339, 390, 399, 416, 603, 1656, 1711, 1725, 1905 and 1910 (numbered relative to mature native human FVIII). In another embodiment of the method, the CFXTEN comprises a sequence with at least about 80%, or at least about 90%, or at least about 95%, or at least about 97%, or at least about 99% sequence identity compared to a sequence selected from any one of Table 21.

Figure 13:
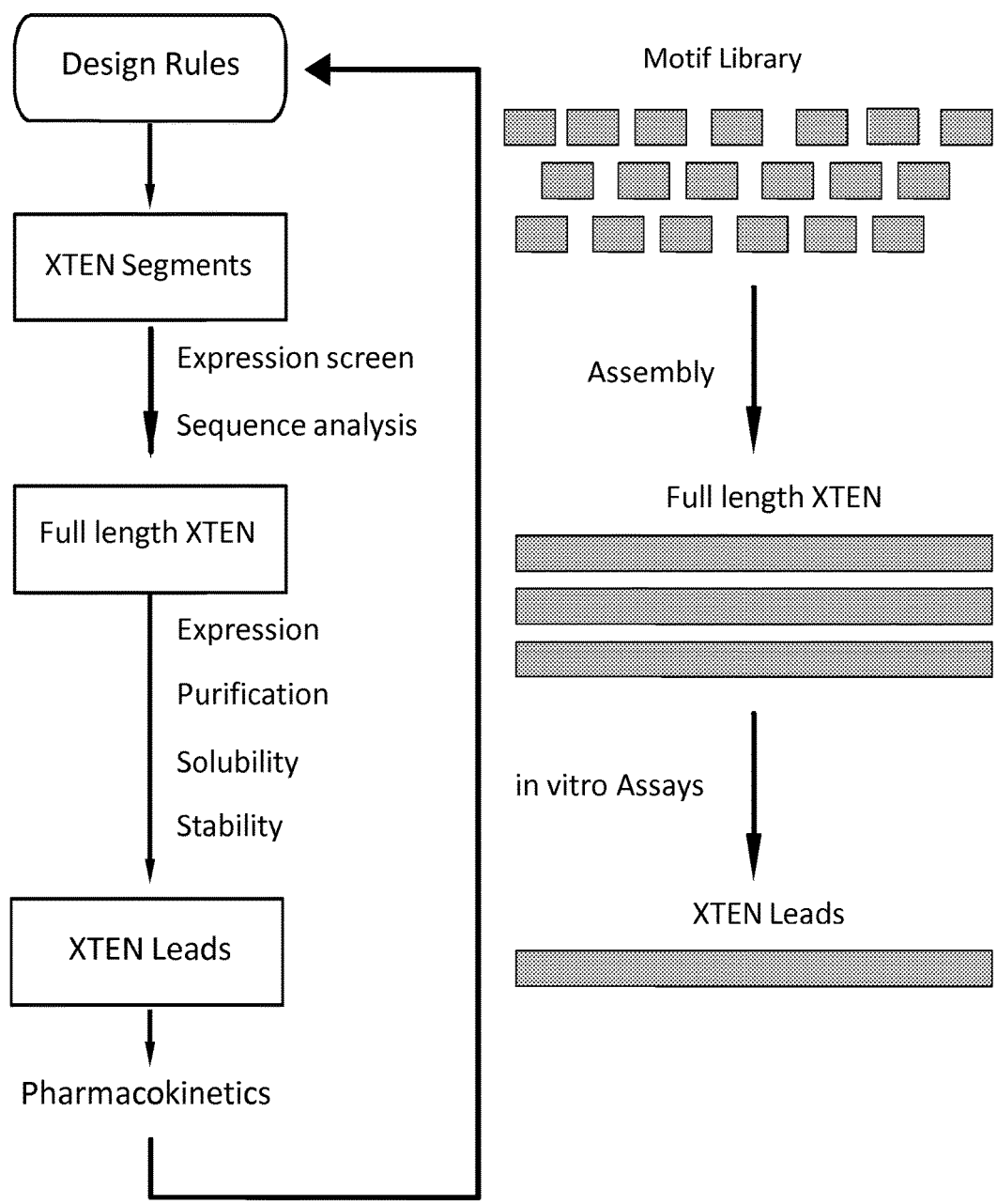

In another aspect, the invention provides a method of making the CFXTEN compositions to achieve desired pharmacokinetic, pharmacologic or pharmaceutical properties. In general, the steps in the design and production of the inventive fusion protein compositions, as illustrated in FIGS. 11-13, include: (1) the selection of a FVIII (e.g., native proteins, sequences of Table 1, analogs or derivatives with activity) to treat the particular condition; (2) selecting one or more XTEN (e.g., sequences with at least 80% identity to sequences set forth in Table 4) that will confer the desired pharmacokinetic and physicochemical characteristics on the resulting CFXTEN (e.g., the administration of the CFXTEN composition to a subject results in the fusion protein being maintained above 0.05-0.4 IU/ml for a greater period compared to FVIII not linked to XTEN); (3) establishing a desired N- to C-terminus configuration of the CFXTEN to achieve the desired efficacy or PK parameters (e.g., selecting one or more insertion sites from Table 5, Table 6, Table 7, Table 8, and Table 9); (4) establishing the design of the expression vector encoding the configured CFXTEN; (5) transforming a suitable host with the expression vector; and (6) expressing and recovering the resultant isolated CFXTEN fusion protein. In one embodiment of the method of making CFXTEN, the XTEN for insertion are evaluated by the application of Equation IV to maximize the Ratio XTEN Radii for the fusion protein construct, with the XTEN resulting in values greater than 2.0, or 2.1, or 2.2, or 2.3, or 2.4, or 2.5, or 2.6, or 2.7, or 2.8, or 2.9, or 3.0 being preferred. For those CFXTEN for which an increase in half-life or an increased period of time spent above the minimum coagulation-effective concentration is desired, the XTEN chosen for incorporation generally have at least about 144, or about 288, or about 432, or about 576, or about 864, or about 875, or about 912, or about 923 amino acid residues where a single XTEN is to be incorporated into the CFXTEN. In another embodiment, the CFXTEN comprises a first XTEN of the foregoing lengths, and at least a second XTEN of about 36, or about 42, or about 72, or about 144, or about 288, or about 576, or about 864, or about 875, or about 912, or about 923, or about 1000 or more amino acid residues. The location of the XTEN within the fusion protein can include one, two, three, four, five or more locations selected from Table 5, Table 6, Table 7, Table 8, and Table 9 or FIGS. 8-9. In one embodiment, the method of design includes an insertion of XTEN into the FVIII of at least one site selected from amino acids 32, 220, 224, 336, 339, 390, 399, 416, 603, 1656, 1711, 1725, 1905 and 1910 (numbered relative to mature native human FVIII).

In another aspect, the invention provides methods of making CFXTEN compositions to improve ease of manufacture, result in increased stability, increased water solubility, and/or ease of formulation, as compared to the native FVIII. In one embodiment, the invention includes a method of increasing the water solubility of a FVIII comprising the step of linking the FVIII with at least about 80%, or about 90%, or about 95% identity to a sequence from Table 1 to one or more XTEN at one, two, three, four, five or more locations selected from Table 5, Table 6, Table 7, Table 8, and Table 9 or FIG. 8-9 wherein the XTEN is a sequence with at least about 80%, or about 90%, or about 95% sequence identity compared to a sequence from any one of Tables 3, 4, and 13-17 such that a higher concentration in soluble form of the resulting CFXTEN can be achieved, under physiologic conditions, compared to the FVIII in an un-fused state. In a particular embodiment, the CFXTEN comprises a FVIII linked to two, three, four, or five XTEN having at least about 24, or about 36, or about 48, or about 60, or about 72, or about 84, or about 96, or about 144, or about 288 amino acid residues inserted at sites selected from Table 5, Table 6, Table 7, Table 8, and Table 9 or FIGS. 8-9, in which the solubility of the fusion protein under physiologic conditions is at least three-fold greater than the corresponding FVIII not linked to XTEN, or alternatively, at least four-fold, or five-fold, or six-fold, or seven-fold, or eight-fold, or nine-fold, or at least 10-fold, or at least 20-fold, or at least 30-fold, or at least 50-fold, or at least 60-fold or greater than FVIII not linked to XTEN. Factors that contribute to the property of XTEN to confer increased water solubility of CFs when incorporated into a fusion protein include the high solubility of the XTEN fusion partner and the low degree of self-aggregation between molecules of XTEN in solution, as well as expanding the hydrophilicity of FVIII external loops into which the XTEN is inserted. In some embodiments, the method results in a CFXTEN fusion protein wherein the water solubility is at least about 20%, or at least about 30% greater, or at least about 50% greater, or at least about 75% greater, or at least about 90% greater, or at least about 100% greater, or at least about 150% greater, or at least about 200% greater, or at least about 400% greater, or at least about 600% greater, or at least about 800% greater, or at least about 1000% greater, or at least about 2000% greater under physiologic conditions, compared to the un-fused FVIII. In one embodiment, the XTEN of the CFXTEN fusion protein is a sequence with at least about 80%, or about 90%, or about 95% sequence identity compared to a sequence from any one of Tables 3, 4, and 13-17. In another embodiment, the invention includes a method of increasing the shelf-life of a FVIII comprising the step of linking the FVIII with one or more XTEN at one or more sites selected from Table 5, Table 6, Table 7, Table 8, and Table 9, wherein the shelf-life of the resulting CFXTEN is extended compared to the FVIII in an un-fused state. As used herein, shelf-life refers to the period of time over which the procoagulant activity of a FVIII or CFXTEN that is in solution, lyophilized or in some other storage formulation remains stable without undue loss of activity or that remains within release specifications established for the pharmaceutical composition. A FVIII that degrades or aggregates generally has reduced functional activity or reduced bioavailability compared to one that remains in solution. Factors that contribute to the ability of the method to extend the shelf life of FVIII when incorporated into a fusion protein include increased water solubility, reduced self-aggregation in solution, and increased heat stability of the XTEN fusion partner. In particular, the low tendency of XTEN to aggregate facilitates methods of formulating pharmaceutical preparations containing higher drug concentrations of CFs, and the heat-stability of XTEN contributes to the property of CFXTEN fusion proteins to remain soluble and functionally active for extended periods. The method results in CFXTEN fusion proteins with prolonged or extended shelf-life that exhibit greater activity relative to a FVIII standard that has been subjected to the same storage and handling conditions. The standard may be the un-fused full-length FVIII or a commercially-available FVIII pharmaceutical composition. In one embodiment, the method includes the step of formulating the isolated CFXTEN with one or more pharmaceutically acceptable excipients that enhance the ability of the XTEN to retain its unstructured conformation and for the CFXTEN to remain soluble in the formulation for a time that is greater than that of the corresponding un-fused FVIII. In one embodiment, the method comprises linking a FVIII selected from Table 1 to one or more XTEN selected from any one of Tables 3, 4, and 13-17 inserted at one or more sites selected from Table 5, Table 6, Table 7, Table 8, and Table 9 and admixing with at least one pharmaceutically acceptable excipient to create a pharmaceutical composition that retains greater than about 100% of the procoagulant activity, or greater than about 105%, 110%, 120%, 130%, 150% or 200% of the procoagulant activity of a FVIII standard subjected to the same storage and handling conditions when compared at a time point of at least 90 days, or at least 6 months, or at least 12 months. Shelf-life may also be assessed in terms of functional activity remaining after storage, normalized to functional activity when storage began. In some embodiments, CFXTEN pharmaceutical compositions of the invention retain about 50% more procoagulant activity, or about 60%, 70%, 80%, or 90% more of the procoagulant activity of a FVIII standard when subjected to the same conditions for the same period of up to 2 weeks, or 4 weeks, or 6 weeks or longer under various temperature conditions. In one embodiment, the CFXTEN pharmaceutical composition retains at least about 50%, or about 60%, or at least about 70%, or at least about 80%, and most preferably at least about 90% or more of its original activity in solution when heated at 80° C. for 10 min. In another embodiment, the CFXTEN pharmaceutical composition retains at least about 50%, preferably at least about 60%, or at least about 70%, or at least about 80%, or alternatively at least about 90% or more of its original activity in solution when heated or maintained at 37° C. for about 7 days. In another embodiment, CFXTEN pharmaceutical composition retains at least about 80% or more of its functional activity after exposure to a temperature of about 30° C. to about 70° C. over a period of time of about one hour to about 18 hours. In the foregoing embodiments hereinabove described in this paragraph, the retained activity of the CFXTEN pharmaceutical compositions is at least about two-fold, or at least about three-fold, or at least about four-fold, or at least about five-fold, or at least about six-fold greater at a given time point than that of a corresponding pharmaceutical composition comprising FVIII not linked to the XTEN.

VII). The Nucleic Acids Sequences of the Invention

The present invention provides isolated polynucleic acids encoding CFXTEN chimeric fusion proteins and sequences complementary to polynucleic acid molecules encoding CFXTEN chimeric fusion proteins, including homologous variants thereof. In another aspect, the invention encompasses methods to produce polynucleic acids encoding CFXTEN chimeric fusion proteins and sequences complementary to polynucleic acid molecules encoding CFXTEN chimeric fusion protein, including homologous variants thereof. In general, and as illustrated in FIGS. 11-13, the methods of producing a polynucleotide sequence coding for a CFXTEN fusion protein and expressing the resulting gene product include assembling nucleotides encoding FVIII and XTEN, ligating the components in frame, incorporating the encoding gene into an expression vector appropriate for a host cell, transforming the appropriate host cell with the expression vector, and culturing the host cell under conditions causing or permitting the fusion protein to be expressed in the transformed host cell, thereby producing the biologically-active CFXTEN polypeptide, which is recovered as an isolated fusion protein by standard protein purification methods known in the art. Standard recombinant techniques in molecular biology is used to make the polynucleotides and expression vectors of the present invention.

In accordance with the invention, nucleic acid sequences that encode CFXTEN (or its complement) are used to generate recombinant DNA molecules that direct the expression of CFXTEN fusion proteins in appropriate host cells. For the purposes of the invention, nucleic acid encoding a signal peptide corresponding to that of native human FVIII (encoding MQIELSTCFFLCLLRFCFS (SEQ ID NO: 1611)) can be added to any of the encoding constructs described herein to aid in the expression and secretion of the CFXTEN fusion protein. In one embodiment, the nucleic acid add is ATGCAAATAGAGCTCTCCACCTGCTTCTTTCTGTGCCTTTTGCGATTCTGCTTTAGT (SEQ ID NO: 1613), or the complement thereof.

Several cloning strategies are suitable for performing the present invention, many of which is used to generate a construct that comprises a gene coding for a fusion protein of the CFXTEN composition of the present invention, or its complement. In some embodiments, the cloning strategy is used to create a gene that encodes a monomeric CFXTEN that comprises at least a first FVIII and at least a first XTEN polypeptide, or their complement. In one embodiment of the foregoing, the gene comprises a sequence encoding a FVIII or sequence variant. In other embodiments, the cloning strategy is used to create a gene that encodes a monomeric CFXTEN that comprises nucleotides encoding at least a first molecule of FVIII or its complement and a first and at least a second XTEN or their complement that is used to transform a host cell for expression of the fusion protein of the CFXTEN composition. In the foregoing embodiments hereinabove described in this paragraph, the genes can further comprise nucleotides encoding spacer sequences that also encode cleavage sequence(s).

In designing a desired XTEN sequences, it was discovered that the non-repetitive nature of the XTEN of the inventive compositions is achieved despite use of a "building block" molecular approach in the creation of the XTEN-encoding sequences. This was achieved by the use of a library of polynucleotides encoding peptide sequence motifs, described above, that are then ligated and/or multimerized to create the genes encoding the XTEN sequences (see FIGS. 11 and 12 and Examples). Thus, while the XTEN(s) of the expressed fusion protein may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to CFXTEN fusion protein. DNA encoding the FVIII of the compositions is obtained synthetically, from a commercial source, or from a cDNA library prepared using standard methods from tissue or isolated cells believed to possess FVIII mRNA and to express it at a detectable level. If necessary, the coding sequence can be obtained using conventional primer extension procedures as described in Sambrook, et al., supra, to detect precursors and processing intermediates of mRNA that may not have been reverse-transcribed into cDNA. One can then use polymerase chain reaction (PCR) methodology to amplify the target DNA or RNA coding sequence to obtain sufficient material for the preparation of the CFXTEN constructs containing the FVIII gene. Assays can then be conducted to confirm that the hybridizing full-length genes are the desired FVIII gene(s). By these conventional methods, DNA can be conveniently obtained from a cDNA library prepared from such sources. The FVIII encoding gene(s) can also created by standard synthetic procedures known in the art (e.g., automated nucleic acid synthesis using, for example one of the methods described in Engels et al. (Agnew. Chem. Int. Ed. Engl., 28:716-734 1989)), using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the protein of interest or of a fragment or variant of the protein. In one embodiment, the FVIII encoding gene encodes a protein sequence from Table 1, or a fragment or variant thereof.

A gene or polynucleotide encoding the FVIII portion of the subject CFXTEN protein, in the case of an expressed fusion protein that comprises a single FVIII, is then cloned into a construct, which is a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the FVIII gene by cloning it into the construct adjacent and in frame with the gene(s) coding for the FVIII. This second step occurs through a ligation or multimerization step. In the foregoing embodiments hereinabove described in this paragraph, it is to be understood that the gene constructs that are created can alternatively be the complement of the respective genes that encode the respective fusion proteins.

The gene encoding for the XTEN can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate short sequences of polynucleotides encoding XTEN into longer XTEN genes of a desired length and sequence. In one embodiment, the method ligates two or more codon-optimized oligonucleotides encoding XTEN motif or segment sequences of about 9 to 14 amino acids, or about 12 to 20 amino acids, or about 18 to 42 amino acids, or about 42 to about 144 amino acids, or about 144 to about 288 amino acids, or 288 to about 864 amino acids or longer, or any combination of the foregoing ranges of motif or segment lengths.

Alternatively, the disclosed method is used to multimerize XTEN-encoding sequences into longer sequences of a desired length; e.g., a gene encoding 36 amino acids of XTEN can be dimerized into a gene encoding 72 amino acids, then 144, then 288, etc. Even with multimerization, XTEN polypeptides can be constructed such that the XTEN-encoding gene has low or virtually no repetitiveness through design of the codons selected for the motifs of the shortest unit being used, which can reduce recombination and increase stability of the encoding gene in the transformed host.

Genes encoding XTEN with non-repetitive sequences are assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as described above. The resulting genes are then assembled with genes encoding FVIII or regions of FVIII, as illustrated in FIGS. 11 and 12, and the resulting genes used to transform a host cell and produce and recover the CFXTEN for evaluation of its properties, as described herein.

In another aspect, the invention provides isolated nucleic acids comprising a polynucleotide sequence encoding the CFXTEN fusion protein embodiments described herein. In one embodiment, the isolated nucleic acid comprises a polynucleotide sequence selected from (a) a sequence having at least about 80% sequence identity, or about 90%, or about 91%, or about 92%, or about 93%, or about 94%, or about 95%, or about 96%, or about 97%, or about 98%, or about 99%, to about 100% sequence identity compared to a sequence of comparable length selected from Table 21, when optimally aligned, or (b) the complement of the polynucleotide of (a). In another embodiment, the isolated nucleic acid comprises the sequence ATGCAAATAGAGCTCTCCACCTGCTTCTTTCTGTGCCTTTTGC-GATTCTGCTTTAGT (SEQ ID NO: 1613) linked to the 5' end of the nucleic acid of (a) or the complement of the sequence linked to the 3' end of (b).

Polynucleotide Libraries

In another aspect, the invention provides libraries of polynucleotides that encode XTEN sequences that are used to assemble genes that encode XTEN of a desired length and sequence.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences, as depicted schematically in FIG. 13. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes, e.g., 12 amino acid motifs can be dimerized and/or ligated into a library of polynucleotides that encode 36 amino acids. Libraries encoding motifs of different lengths; e.g., 9-14 amino acid motifs leading to libraries encoding 27 to 42 amino acids are contemplated by the invention. In turn, the library of polynucleotides that encode 27 to 42 amino acids, and preferably 36 amino acids (as described in the Examples) can be serially dimerized into a library containing successively longer lengths of polynucleotides that encode XTEN sequences of a desired length for incorporation into the gene encoding the CFXTEN fusion protein, as disclosed herein.

Figure 18:
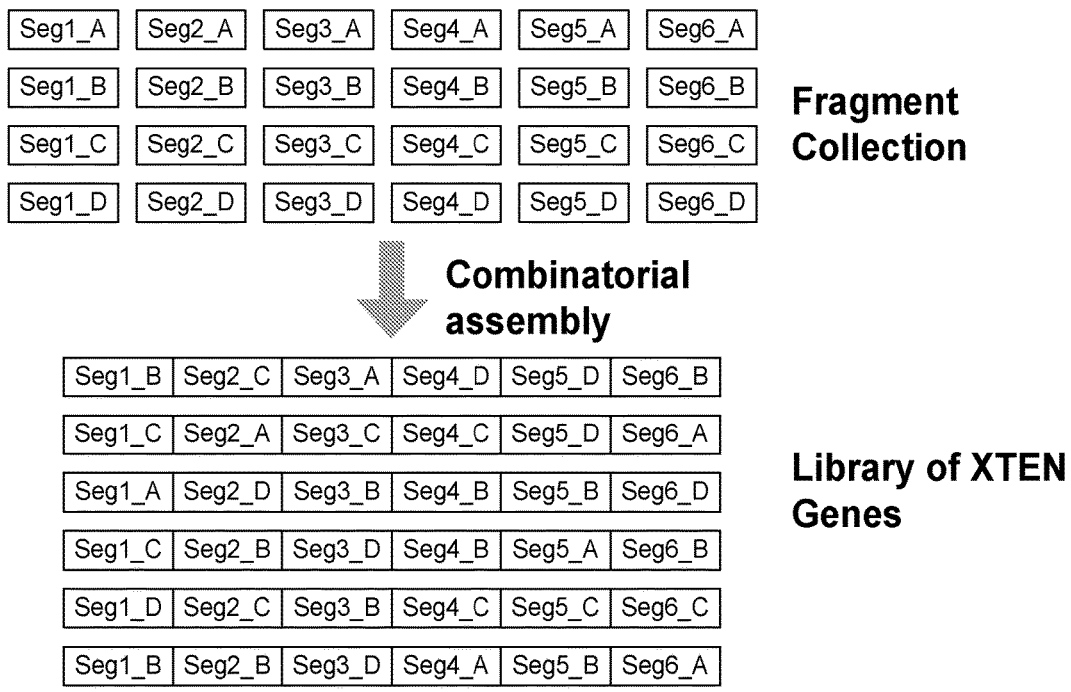
FIG. 18 illustrates the process of combinatorial gene assembly of genes encoding XTEN. In this case, the genes are assembled from 6 base fragments and each fragment is available in 4 different codon versions (A, B, C and D). This allows for a theoretical diversity of 4096 in the assembly of a 12 amino acid motif.

A more efficient way to optimize the DNA sequence encoding XTEN is based on combinatorial libraries. The gene encoding XTEN can be designed and synthesized in segment such that multiple codon versions are obtained for each segment. These segments can be randomly assembled into a library of genes such that each library member encodes the same amino acid sequences but library members comprise a large number of codon versions. Such libraries can be screened for genes that result in high-level expression and/or a low abundance of truncation products. The process of combinatorial gene assembly is illustrated in FIG. 18. The genes in FIG. 18 are assembled from 6 base fragments and each fragment is available in 4 different codon versions. This allows for a theoretical diversity of 4096.

In some embodiments, libraries are assembled of polynucleotides that encode amino acids that are limited to specific sequence XTEN families; e.g., the AD, AE, AF, AG, AM, or AQ sequences of Table 4. In other embodiments, libraries comprise sequences that encode two or more of the motif family sequences from Table 3. The names and sequences of representative, non-limiting polynucleotide sequences of libraries that encode 36mers are presented in Tables 13-17, and the methods used to create them are described more fully in the respective Examples. In other embodiments, libraries that encode XTEN are constructed from segments of polynucleotide codons linked in a randomized sequence that encode amino acids wherein at least about 80%, or at least about 90%, or at least about 91%, or at least about 92%, or at least about 93%, or at least about 94%, or at least about 95%, or at least about 97%, or at least about 98%, or at least about 99% of the codons are selected from the group consisting of condons for glycine (G), alanine (A), serine (S), threonine (T), glutamate (E) and proline (P) amino acids. The libraries can be used, in turn, for serial dimerization or ligation to achieve polynucleotide sequence libraries that encode XTEN sequences, for example, of 42, 48, 72, 144, 288, 576, 864, 875, 912, 923, 1318 amino acids, or up to a total length of about 3000 amino acids, as well as intermediate lengths, in which the encoded XTEN can have one or more of the properties disclosed herein, when expressed as a component of a CFXTEN fusion protein. In some cases, the polynucleotide library sequences may also include additional bases used as "sequencing islands," described more fully below.

Figure 14:
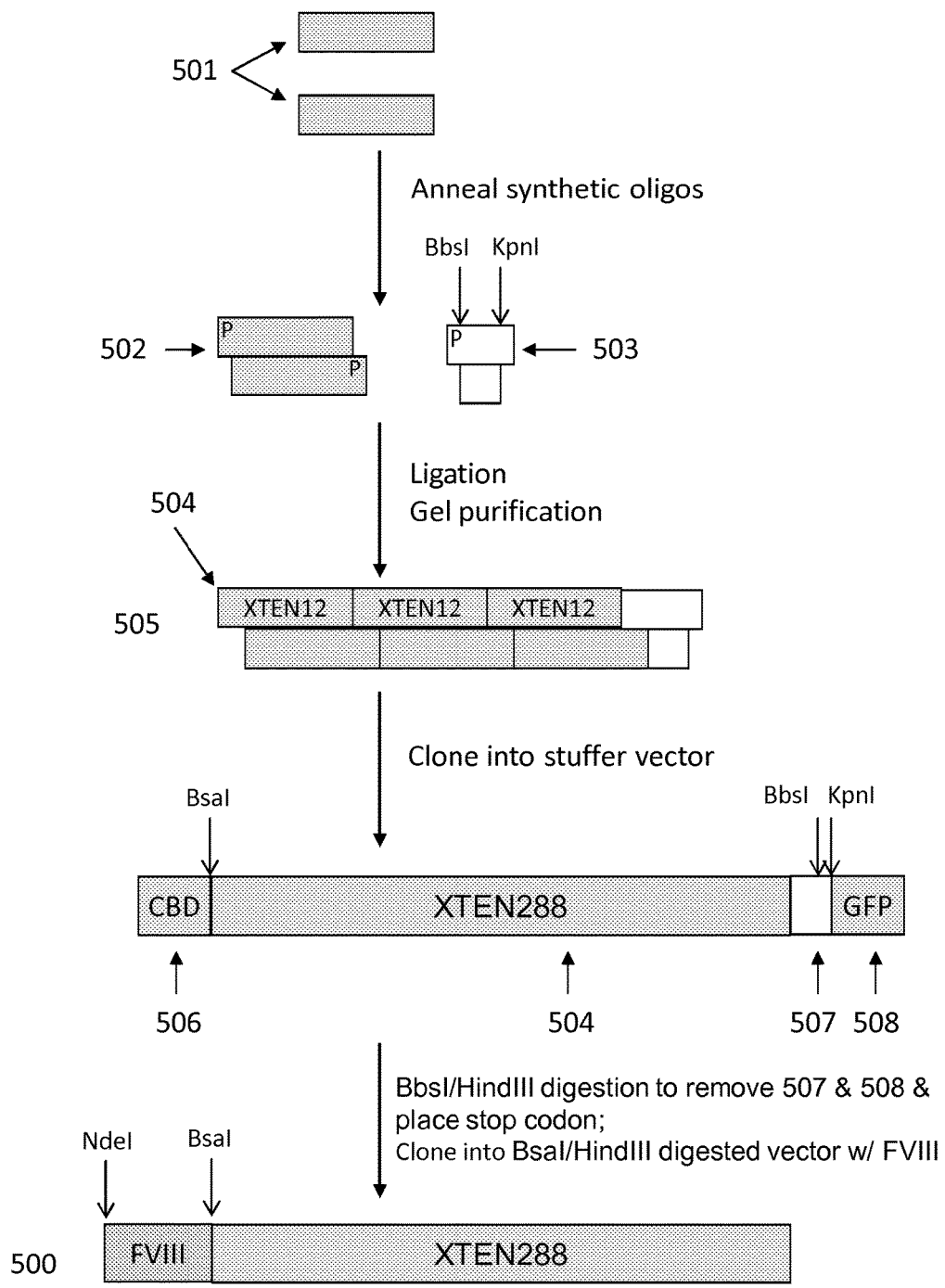

FIG. 14 is a schematic flowchart of representative, non-limiting steps in the assembly of a XTEN polynucleotide construct and a CFXTEN polynucleotide construct in the embodiments of the invention. Individual oligonucleotides 501 are annealed into sequence motifs 502 such as a 12 amino acid motif ("12-mer"), which is ligated to additional sequence motifs from a library to create a pool that encompasses the desired length of the XTEN 504, as well as ligated to a smaller concentration of an oligo containing BbsI, and KpnI restriction sites 503. The resulting pool of ligation products is gel-purified and the band with the desired length of XTEN is cut, resulting in an isolated XTEN gene with a stopper sequence 505. The XTEN gene is cloned into a stuffer vector. In this case, the vector encodes an optional CBD sequence 506 and a GFP gene 508. Digestion is than performed with BbsI/HindIII to remove 507 and 508 and place the stop codon. The resulting product is then cloned into a BsaI/HindIII digested vector containing a gene encoding the FVIII, resulting in the gene 500 encoding an FVIII-XTEN fusion protein.

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferace, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have very repetitive amino acid sequences. Codon optimization is performed using computer programs (Gustafsson, C., et al. (2004) *Trends Biotechnol*, 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in *E. coli*). In the case of *E. coli*, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

In one embodiment, polynucleotide libraries are constructed using the disclosed methods wherein all members of the library encode the same amino acid sequence but where codon usage for the respective amino acids in the sequence is varied or optimized for the intended host cell. Such libraries can be screened for highly expressing and genetically stable members that are particularly suitable for the large-scale production of XTEN-containing products. In one embodiment, the libraries are optimized for expression in a eukaryotic host cell.

Optionally, one can sequence clones in the library to eliminate isolates that contain undesirable sequences. The initial library of short XTEN sequences allows some variation in amino acid sequence. For instance one can randomize some codons such that a number of hydrophilic amino acids can occur in a particular position. During the process of iterative multimerization one can screen the resulting library members for other characteristics like solubility or protease resistance in addition to a screen for high-level expression.

Once the gene that encodes the XTEN of desired length and properties is selected, it is genetically fused at the desired location to the nucleotides encoding the FVIII gene(s) by cloning it into the construct adjacent and in frame with the gene coding for FVIII, or alternatively between nucleotides encoding adjacent domains of the FVIII, or alternatively within a sequence encoding a given FVIII domain, or alternatively in frame with nucleotides encoding a spacer/cleavage sequence linked to a terminal XTEN. The invention provides various permutations of the foregoing, depending on the CFXTEN to be encoded. For example, a gene encoding a CFXTEN fusion protein comprising a FVIII and two XTEN, such as embodied by formula VI, as depicted above, the gene would have polynucleotides encoding FVIII, encoding two XTEN, which can be identical or different in composition and sequence length. In one non-limiting embodiment of the foregoing, the FVIII polynucleotides would encode factor VIII and the polynucleotides encoding the C-terminus XTEN would encode an XTEN of 288 amino acids and the polynucleotides encoding an internal XTEN adjacent to the C-terminus of the A2 domain would encode an XTEN of 144 amino acids. The step of cloning the FVIII genes into the XTEN construct can occur through a ligation or multimerization step, as shown in FIG. 14. The constructs encoding CFXTEN fusion proteins can be designed in different configurations of the components XTEN, CF, and spacer sequences, such as the configurations of formulae I-VIII. In one embodiment, the construct comprises polynucleotide sequences complementary to, or those that encode a monomeric polypeptide of components in the following order (5' to 3') FVIII, an XTEN internal to the B domain, and a C-terminal XTEN. In another embodiment, the construct comprises polynucleotide sequences complementary to, or those that encode a monomeric polypeptide of components in the following order (5' to 3') FVIIII, spacer sequence linked to the C-terminus, and XTEN. The spacer polynucleotides can optionally comprise sequences encoding cleavage sequences. As will be apparent to those of skill in the art, multiple permutations of FVIII domains and inserted XTEN are possible.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the CFXTEN sequences under stringent conditions, such as those described herein.

The resulting polynucleotides encoding the CFXTEN chimeric fusion proteins can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature.

Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated. Representative plasmids are illustrated in FIG. 17, with encoding regions for different configurations of FVIII and XTEN components portrayed.

The invention provides for the use of plasmid vectors containing replication and control sequences that are compatible with and recognized by the host cell, and are operably linked to the CFXTEN gene for controlled expression of the CFXTEN fusion proteins. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the fusion protein in a suitable host. The requirements are that the vectors are replicable and viable in the host cell of choice. Low- or high-copy number vectors may be used as desired.

Other suitable vectors include, but are not limited to, derivatives of SV40 and pcDNA and known bacterial plasmids such as col E1, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. Yeast expression systems that can also be used in the present invention include, but are not limited to, the non-fusion pYES2 vector (Invitrogen), the fusion pYESHisA, B, C (Invitrogen), pRS vectors and the like.

The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell.

Examples of suitable promoters for directing the transcription of the DNA encoding the FVIII polypeptide variant in mammalian cells are the SV40 promoter (Subramani et al., *Mol. Cell. Biol.* 1 (1981), 854-864), the MT-1 (metallothionein gene) promoter (Palmiter et al., *Science* 222 (1983), 809-814), the CMV promoter (Boshart et al., Cell 41:521-530, 1985) or the adenovirus 2 major late promoter (Kaufman and Sharp, *Mol. Cell. Biol,* 2:1304-1319, 1982). The vector may also carry sequences such as UCOE (ubiquitous chromatin opening elements).

Examples of suitable promoters for use in filamentous fungus host cells are, for instance, the ADH3 promoter or the tpiA promoter. Examples of other useful promoters are those derived from the gene encoding *A. oryzae* TAKA amylase, *Rhizomucor miehei* aspartic proteinase, *A. niger* neutral α-amylase, *A. niger* acid stable α-amylase, *A. niger* or *A. awamoriglucoamylase* (gluA), *Rhizomucor miehei* lipase, *A. oryzae* alkaline protease, *A. oryzae* triose phosphate isomerase or *A. nidulans* acetamidase. Preferred are the TAKA-amylase and gluA promoters.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci.

USA, 80:21-25 (1983)], all is operably linked to the DNA encoding CFXTEN polypeptides. Promoters for use in bacterial systems can also contain a Shine-Dalgarno (S.D.) sequence, operably linked to the DNA encoding CFXTEN polypeptides.

The invention contemplates use of other expression systems including, for example, a baculovirus expression system with both non-fusion transfer vectors, such as, but not limited to pVL941 Summers, et al., Virology 84:390-402 (1978)), pVL1393 (Invitrogen), pVL1392 (Summers, et al., Virology 84:390-402 (1978) and Invitrogen) and pBlueBacIII (Invitrogen), and fusion transfer vectors such as, but not limited to, pAc7 00 (Summers, et al., Virology 84:390-402 (1978)), pAc701 and pAc70-2 (same as pAc700, with different reading frames), pAc360 Invitrogen) and pBlueBacHisA, B, C (Invitrogen) can be used.

Examples of suitable promoters for directing the transcription of the DNA encoding the FVIII polypeptide variant in mammalian cells are the CMV promoter (Boshart et al., *Cell* 41:521-530, 1985), the SV40 promoter (Subramani et al., *Mol. Cell. Biol.* 1 (1981), 854-864), the MT-1 (metallothionein gene) promoter (Palmiter et al., Science 222 (1983), 809-814), the adenovirus 2 major late promoter (Kaufman and Sharp, *Mol. Cell. Biol,* 2:1304-1319, 1982). The vector may also carry sequences such as UCOE (ubiquitous chromatin opening elements).

The DNA sequences encoding the CFXTEN may also, if necessary, be operably connected to a suitable terminator, such as the hGH terminator (Palmiter et al., Science 222, 1983, pp. 809-814) or the TPI1 terminators (Alber and Kawasaki, *J. Mol. Appl. Gen.* 1, 1982, pp. 419-434) or ADH3 (McKnight et al., *The EMBO J.* 4, 1985, pp. 2093-2099). Expression vectors may also contain a set of RNA splice sites located downstream from the promoter and upstream from the insertion site for the CFXTEN sequence itself, including splice sites obtained from adenovirus. Also contained in the expression vectors is a polyadenylation signal located downstream of the insertion site. Particularly preferred polyadenylation signals include the early or late polyadenylation signal from SV40 (Kaufman and Sharp, ibid.), the polyadenylation signal from the adenovirus 5 Elb region, the hGH terminator (DeNoto et al. Nucl. Acids Res. 9:3719-3730, 1981). The expression vectors may also include a noncoding viral leader sequence, such as the adenovirus 2 tripartite leader, located between the promoter and the RNA splice sites; and enhancer sequences, such as the SV40 enhancer.

To direct the CFXTEN of the present invention into the secretory pathway of the host cells, a secretory signal sequence (a.k.a., a leader sequence, a prepro sequence, or a pre sequence) may be included in the recombinant vector. The secretory signal sequence is operably linked to the DNA sequences encoding the CFXTEN, usually positioned 5' to the DNA sequence encoding the CFXTEN fusion protein. The secretory signal sequence may be that, normally associated with the native FVIII protein or may be from a gene encoding another secreted protein. Non-limiting examples include OmpA, PhoA, and DsbA for *E. coli* expression, ppL-alpha, DEX4, invertase signal peptide, acid phosphatase signal peptide, CPY, or INU1 for yeast expression, and IL2L, SV40, IgG kappa and IgG lambda for mammalian expression. Signal sequences are typically proteolytically removed from the protein during the translocation and secretion process, generating a defined N-terminus. Methods are disclosed in Arnau, et al., Protein Expression and Purification 48: 1-13 (2006).

The procedures used to ligate the DNA sequences coding for the CFXTEN, the promoter and optionally the terminator and/or secretory signal sequence, respectively, and to insert them into suitable vectors containing the information necessary for replication, are well known to persons skilled in the art (cf., for instance, Sambrook, J. et al., "Molecular Cloning: A Laboratory Manual," 3$^{rd}$ edition, Cold Spring Harbor Laboratory Press, 2001). In this manner, a chimeric DNA molecule coding for a monomeric CFXTEN fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule.

Non-limiting examples of mammalian cell lines for use in the present invention are the COS-1 (ATCC CRL 1650), COS-7 (ATCC CRL 1651), BHK-21 (ATCC CCL 10)) and BHK-293 (ATCC CRL 1573; Graham et al., *J. Gen. Virol.* 36:59-72, 1977), BHK-570 cells (ATCC CRL 10314), CHO-K1 (ATCC CCL 61), CHO-S (Invitrogen 11619-012), and 293-F (Invitrogen R790-7), and the parental and derivative cell lines known in the art useful for expression of FVIII. A tk-ts13 BHK cell line is also available from the ATCC under accession number CRL 1632. In addition, a number of other cell lines may be used within the present invention, including Rat Hep I (Rat hepatoma; ATCC CRL 1600), Rat Hep II (Rat hepatoma; ATCC CRL 1548), TCMK (ATCC CCL 139), Human lung (ATCC HB 8065), NCTC 1469 (ATCC CCL 9.1), CHO (ATCC CCL 61) and DUKX cells (Urlaub and Chasin, *Proc. Natl. Acad. Sci. USA* 77:4216-4220, 1980).

Examples of suitable yeasts cells include cells of *Saccharomyces* spp. or *Schizosaccharomyces* spp., in particular strains of *Saccharomyces cerevisiae* or *Saccharomyces kluyveri*. Methods for transforming yeast cells with heterologous DNA and producing heterologous polypeptides there from are described, e.g. in U.S. Pat. Nos. 4,599,311, 4,931,373, 4,870,008, 5,037,743, and U.S. Pat. No. 4,845,075, all of which are hereby incorporated by reference. Transformed cells are selected by a phenotype determined by a selectable marker, commonly drug resistance or the ability to grow in the absence of a particular nutrient, e.g. leucine. A preferred vector for use in yeast is the POT1 vector disclosed in U.S. Pat. No. 4,931,373. The DNA sequences encoding the CFXTEN may be preceded by a signal sequence and optionally a leader sequence, e.g. as described above. Further examples of suitable yeast cells are strains of *Kluyveromyces*, such as *K. lactis, Hansenula,* e.g. *H. polymorpha,* or *Pichia,* e.g. *P. pastoris* (cf. Gleeson et al., *J. Gen. Microbiol.* 132, 1986, pp. 3459-3465; U.S. Pat. No. 4,882,279). Examples of other fungal cells are cells of filamentous fungi, e.g. *Aspergillus* spp., *Neurospora* spp., *Fusarium* spp. or *Trichoderma* spp., in particular strains of *A. oryzae, A. nidulans* or *A. niger*. The use of *Aspergillus* spp. for the expression of proteins is described in, e.g., EP 272 277, EP 238 023, EP 184 438 The transformation of *F. oxysporum* may, for instance, be carried out as described by Malardier et al., 1989, *Gene* 78: 147-156. The transformation of *Trichoderma* spp. may be performed for instance as described in EP 244 234.

Other suitable cells that can be used in the present invention include, but are not limited to, prokaryotic host cells strains such as *Escherichia coli,* (e.g., strain DH5-a), *Bacillus subtilis, Salmonella typhimurium,* or strains of the genera of *Pseudomonas, Streptomyces* and *Staphylococcus.* Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma;* and *Vibrio.*

Methods of transfecting mammalian cells and expressing DNA sequences introduced in the cells are described in e.g., Kaufman and Sharp, *J. Mol. Biol.* 159 (1982), 601-621; Southern and Berg, *J. Mol. Appl. Genet.* 1 (1982), 327-341; Loyter et al., *Proc. Natl. Acad. Sci. USA* 79 (1982), 422-426; Wigler et al., *Cell* 14 (1978), 725; Corsaro and Pearson, *Somatic Cell Genetics* 7 (1981), 603, Graham and van der Eb, Virology 52 (1973), 456; and Neumann et al., EMBO J. 1 (1982), 841-845.

Cloned DNA sequences are introduced into cultured mammalian cells by, for example, calcium phosphate-mediated transfection (Wigler et al., Cell 14:725-732, 1978; Corsaro and Pearson, Somatic Cell Genetics 7:603-616, 1981; Graham and Van der Eb, Virology 52d:456-467, 1973), transfection with many commercially available reagents such as FuGENEG Roche Diagnostics, Mannheim, Germany) or lipofectamine (Invitrogen) or by electroporation (Neumann et al., EMBO J. 1:841-845, 1982). To identify and select cells that express the exogenous DNA, a gene that confers a selectable phenotype (a selectable marker) is generally introduced into cells along with the gene or cDNA of interest. Preferred selectable markers include genes that confer resistance to drugs such as neomycin, hygromycin, puromycin, zeocin, and methotrexate. The selectable marker may be an amplifiable selectable marker. A preferred amplifiable selectable marker is a dihydrofolate reductase (DHFR) sequence. Further examples of selectable markers are well known to one of skill in the art and include reporters such as enhanced green fluorescent protein (EGFP), beta-galactosidase ($\beta$-gal) or chloramphenicol acetyltransferase (CAT). Selectable markers are reviewed by Thilly (Mammalian Cell Technology, Butterworth Publishers, Stoneham, Mass., incorporated herein by reference). The person skilled in the art will easily be able to choose suitable selectable markers. Any known selectable marker may be employed so long as it is capable of being expressed simultaneously with the nucleic acid encoding a gene product.

Selectable markers may be introduced into the cell on a separate plasmid at the same time as the gene of interest, or they may be introduced on the same plasmid. If, on the same plasmid, the selectable marker and the gene of interest may be under the control of different promoters or the same promoter, the latter arrangement producing a dicistronic message. Constructs of this type are known in the art (for example, Levinson and Simonsen, U.S. Pat. No. 4,713,339). It may also be advantageous to add additional DNA, known as "carrier DNA," to the mixture that is introduced into the cells.

After the cells have taken up the DNA, they are grown in an appropriate growth medium, typically 1-2 days, to begin expressing the gene of interest. As used herein the term "appropriate growth medium" means a medium containing nutrients and other components required for the growth of cells and the expression of the CFXTEN of interest. Media generally include a carbon source, a nitrogen source, essential amino acids, essential sugars, vitamins, salts, phospholipids, protein and growth factors. For production of gamma-carboxylated proteins, the medium will contain vitamin K, preferably at a concentration of about 0.1 µg/ml to about 5 µg/ml. Drug selection is then applied to select for the growth of cells that are expressing the selectable marker in a stable fashion. For cells that have been transfected with an amplifiable selectable marker the drug concentration may be increased to select for an increased copy number of the cloned sequences, thereby increasing expression levels. Clones of stably transfected cells are then screened for expression of the FVIII polypeptide variant of interest.

The transformed or transfected host cell is then cultured in a suitable nutrient medium under conditions permitting expression of the CFXTEN polypeptide after which the resulting peptide may be recovered from the culture as an isolated fusion protein. The medium used to culture the cells may be any conventional medium suitable for growing the host cells, such as minimal or complex media containing appropriate supplements. Suitable media are available from commercial suppliers or may be prepared according to published recipes (e.g. in catalogues of the American Type Culture Collection). The culture conditions, such as temperature, pH and the like, are those previously used with the host cell selected for expression, and will be apparent to the ordinarily skilled artisan.

Gene expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes. The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence FVIII polypeptide or against a synthetic peptide based on the DNA sequences provided herein or against exogenous sequence fused to FVIII and encoding a specific antibody epitope. Examples of selectable markers are well known to one of skill in the art and include reporters such as enhanced green fluorescent protein (EGFP), beta-galactosidase ($\beta$-gal) or chloramphenicol acetyltransferase (CAT).

Expressed CFXTEN polypeptide product(s) may be purified via methods known in the art or by methods disclosed herein. Procedures such as gel filtration, affinity purification (e.g., using an anti-FVIII antibody column), salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Additional purification may be achieved by conventional chemical purification means, such as high performance liquid chromatography. Some expressed CFXTEN may require refolding during isolation and purification. Methods of purification are described in Robert K. Scopes, Protein Purification Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994). For therapeutic purposes it is preferred that the CFXTEN fusion proteins of the invention are substantially pure. Thus, in a preferred embodiment of the invention the CFXTEN of the invention is purified to at least about 90 to 95% homogeneity, preferably to at least about 98% homogeneity. Purity may be assessed by, e.g., gel electrophoresis, HPLC, and amino-terminal amino acid sequencing.

VIII). Pharmaceutical Compositions

The present invention provides pharmaceutical compositions comprising CFXTEN. In one embodiment, the pharmaceutical composition comprises a CFXTEN fusion protein disclosed herein admixed with at least one pharmaceutically acceptable carrier. CFXTEN polypeptides of the present invention can be formulated according to known methods to prepare pharmaceutically useful compositions, whereby the polypeptide is combined in admixture with a pharmaceutically acceptable carrier vehicle, such as aqueous solutions, buffers, solvents and/or pharmaceutically acceptable suspensions, emulsions, stabilizers or excipients. Examples of non-aqueous solvents include propyl ethylene glycol, polyethylene glycol and vegetable oils. Formulations of the pharmaceutical compositions are prepared for storage by mixing the active CFXTEN ingredient having the desired degree of purity with optional physiologically acceptable carriers, excipients (e.g., sodium chloride, a calcium salt, sucrose, or polysorbate) or stabilizers (e.g., sucrose, trehalose, raffinose, arginine, a calcium salt, glycine or histidine), as described in Remington's Pharmaceutical Sciences 16th edition, Osol, A. Ed. (1980), in the form of lyophilized formulations or aqueous solutions.

The pharmaceutical composition may be supplied as a lyophilized powder to be reconstituted prior to administration. In another embodiment, the pharmaceutical composition may be supplied in a liquid form in a vial, the contents of which can be administered directly to a patient. Alternatively, the composition is supplied as a liquid in a pre-filled syringe for administration of the composition. In another embodiment, the composition is supplied as a liquid in a pre-filled vial that can be incorporated into a pump.

The pharmaceutical compositions can be administered by any suitable means or route, including subcutaneously, subcutaneously by infusion pump, intramuscularly, and intravenously. It will be appreciated that the preferred route will vary with the disease and age of the recipient, and the severity of the condition being treated.

In one embodiment, the CFXTEN pharmaceutical composition in liquid form or after reconstitution (when supplied as a lyophilized powder) comprises coagulation factor VIII with an activity of at least 50 IU/ml, or at least 100 IU/ml, or at least 200 IU/ml, or at least 300 IU/ml, or at least 400 IU/ml, or an activity of at least 500 IU/ml, or an activity of at least 600 IU/ml, which composition is capable of increasing factor VIII activity to at least 1.5% of the normal plasma level in the blood for at least about 12 hours, or at least about 24 hours, or at least about 48 hours, or at least about 72 hours, or at least about 96 hours, or at least about 120 hours after administration of the factor VIII pharmaceutical composition to a subject in need of routine prophylaxis. In another embodiment, the CFXTEN pharmaceutical composition in liquid form or after reconstitution (when supplied as a lyophilized powder) comprises coagulation factor VIII with an activity of at least 50 IU/ml, or at least 100 IU/ml, or at least 200 IU/ml, or at least 300 IU/ml, or at least 400 IU/ml, or at least 500 IU/ml, or an activity of at least 600 IU/ml, which composition is capable of increasing factor VIII activity to at least 2.5% of the normal plasma level in the blood for at least about 12 hours, or at least about 24 hours, or at least about 48 hours, or at least about 72 hours, or at least about 96 hours, or at least about 120 hours after administration to a subject in need of routine prophylaxis. It is specifically contemplated that the pharmaceutical compositions of the foregoing can be formulated to include one or more excipients, buffers or other ingredients known in the art to be compatible with administration by the intravenous route or the subcutaneous route or the intramuscular route. Thus, in the embodiments hereinabove described in this paragraph, the pharmaceutical composition is administered subcutaneously, intramuscularly or intravenously.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

In another embodiment, the compositions of the present invention are encapsulated in liposomes, which have demonstrated utility in delivering beneficial active agents in a controlled manner over prolonged periods of time. Liposomes are closed bilayer membranes containing an entrapped aqueous volume. Liposomes may also be unilamellar vesicles possessing a single membrane bilayer or multilamellar vesicles with multiple membrane bilayers, each separated from the next by an aqueous layer. The structure of the resulting membrane bilayer is such that the hydrophobic (non-polar) tails of the lipid are oriented toward the center of the bilayer while the hydrophilic (polar) heads orient towards the aqueous phase. In one embodiment, the liposome may be coated with a flexible water soluble polymer that avoids uptake by the organs of the mononuclear phagocyte system, primarily the liver and spleen. Suitable hydrophilic polymers for surrounding the liposomes include, without limitation, PEG, polyvinylpyrrolidone, polyvinylmethylether, polymethyloxazoline, polyethyloxazoline, polyhydroxypropyloxazoline, polyhydroxypropylmethacrylamide, polymethacrylamide, polydimethylacrylamide, polyhydroxypropylmethacrylate, polyhydroxethylacrylate, hydroxymethylcellulose hydroxyethylcellulose, polyethyleneglycol, polyaspartamide and hydrophilic peptide sequences as described in U.S. Pat. Nos. 6,316,024; 6,126,966; 6,056,973; 6,043,094, the contents of which are incorporated by reference in their entirety. Additional liposomal technologies are described in U.S. Pat. Nos. 6,759,057; 6,406,713; 6,352,716; 6,316,024; 6,294,191; 6,126,966; 6,056,973; 6,043,094; 5,965,156; 5,916,588; 5,874,104; 5,215,680; and 4,684,479, the contents of which are incorporated herein by reference. These describe liposomes and lipid-coated microbubbles, and methods for their manufacture. Thus, one skilled in the art, considering both the disclosure of this invention and the disclosures of these other patents could produce a liposome for the extended release of the polypeptides of the present invention.

For liquid formulations, a desired property is that the formulation be supplied in a form that can pass through a 25, 28, 30, 31, 32 gauge needle for intravenous, intramuscular, intraarticular, or subcutaneous administration.

Syringe pumps may also be used as slow release agents. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

IX). Pharmaceutical Kits

In another aspect, the invention provides a kit to facilitate the use of the CFXTEN polypeptides. The kit comprises the pharmaceutical composition provided herein, a container and a label or package insert on or associated with the container. Suitable containers include, for example, bottles, vials, syringes, etc., formed from a variety of materials such as glass or plastic. The container holds a pharmaceutical composition as a formulation that is effective for treating the FVIII-related condition and may have a sterile access port (for example the container may be an intravenous solution bag or a vial having a stopper pierceable by a hypodermic injection needle). The package insert can list the approved indications for the drug, instructions for the reconstitution and/or administration of the drug for the use for the approved indication, appropriate dosage and safety information, and information identifying the lot and expiration of the drug. In another embodiment of the foregoing, the kit can comprise a second container that can carry a suitable diluent for the pharmaceutical composition, the use of which will provide the user with the appropriate concentration to be delivered to the subject.

EXAMPLES

Example 1: Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus *E. coli* cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence $[X]_3$ where X is a 12mer peptide with the sequences: GESPGGSSGSES (SEQ ID NO: 19), GSEGSSGPGESS (SEQ ID NO: 20), GSSESGSSEGGP (SEQ ID NO: 21), or GSGGEPSESGSS (SEQ ID NO: 22). The insert was obtained by annealing the following pairs of phosphorylated synthetic oligonucleotide pairs:

```
                                           (SEQ ID NO: 1619)
AD1for:  AGGTGAATCTCCDGGTGGYTCYAGCGGTTCYGARTC (SEQ ID NO: 1620)
AD1rev:  ACCTGAYTCRGAACCGCTRGARCCACCHGGAGATTC (SEQ ID NO: 1621)
AD2for:  AGGTAGCGAAGGTTCTTCYGGTCCDGGYGARTCYTC (SEQ ID NO: 1622)
AD2rev:  ACCTGARGAYTCRCCHGGACCRGAAGAACCTTCGCT (SEQ ID NO: 1623)
AD3for:  AGGTTCYTCYGAAAGCGGTTCTTCYGARGGYGGTCC (SEQ ID NO: 1624)
AD3rev:  ACCTGGACCRCCYTCRGAAGAACCGCTTTCRGARGA (SEQ ID NO: 1625)
AD4for:  AGGTTCYGGTGGYGAACCDTCYGARTCTGGTAGCTC
```

We also annealed the phosphorylated oligonucleotide 3 KpnI stopper For: AGGTTCGTCTTCACTCGAGGGTAC (SEQ ID NO: 1626) and the non-phosphorylated oligonucleotide pr_3KpnIstopperRev: CCTCGAGTGAAGACGA (SEQ ID NO: 1627). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs and the sequences for these segments are listed in Table 13.

TABLE 13

DNA and Amino Acid Sequences for AD 36-mer motifs (SEQ ID NOS 203-278, respectively, in order of appearance)

| File name | Amino acid sequence | Nucleotide sequence |
|---|---|---|
| LCW0401_001_GFP-N_A01.ab1 | GSGGEPSESGSSGESPGG SSGSESGESPGGSSGSES | GGTTCTGGTGGCGAACCGTCCGAGTCTGGTAGCTCA GGTGAATCTCCGGGTGGCTCTAGCGGTTCCGAGTCA GGTGAATCTCCTGGTGGTTCCAGCGGTTCCGAGTCA |

TABLE 13-continued

DNA and Amino Acid Sequences for AD 36-mer motifs (SEQ ID NOS 203-278, respectively, in order of appearance)

| File name | Amino acid sequence | Nucleotide sequence |
|---|---|---|
| LCW0401_002_<br>GFP-N_B01.ab1 | GSEGSSGPGESSGESPGG<br>SSGSESGSSESGSSEGGP | GGTAGCGAAGGTTCTTCTGGTCCTGGCGAGTCTTCA<br>GGTGAATCTCCTGGTGGTTCCAGCGGTTCTGAATCA<br>GGTTCCTCCGAAAGCGGTTCTTCCGAGGGCGGTCCA |
| LCW0401_003_<br>GFP-N_C01.ab1 | GSSESGSSEGGPGSSESG<br>SSEGGPGESPGGSSGSES | GGTTCCTCTGAAAGCGGTTCTTCCGAAGGTGGTCCA<br>GGTTCCTCTGAAAGCGGTTCTTCTGAGGGTGGTCCA<br>GGTGAATCTCCGGGTGGCTCCAGCGGTTCCGAGTCA |
| LCW0401_004_<br>GFP-N_D01.ab1 | GSGGEPSESGSSGSSESG<br>SSEGGPGSGGEPSESGSS | GGTTCCGGTGGCGAACCGTCTGAATCTGGTAGCTCA<br>GGTTCTTCTGAAAGCGGTTCTTCCGAGGGTGGTCCA<br>GGTTCTGGTGGTGAACCTTCCGAGTCTGGTAGCTCA |
| LCW0401_007_<br>GFP-N_F01.ab1 | GSSESGSSEGGPGSEGSS<br>GPGESSGSEGSSGPGESS | GGTTCTTCCGAAAGCGGTTCTTCTGAGGGTGGTCCA<br>GGTAGCGAAGGTTCTTCCGGTCCAGGTGAGTCTTCA<br>GGTAGCGAAGGTTCTTCTGGTCCTGGTGAATCTTCA |
| LCW0401_008_<br>GFP-N_G01.ab1 | GSSESGSSEGGPGESPGG<br>SSGSESGSEGSSGPGESS | GGTTCCTCTGAAAGCGGTTCTTCCGAGGGTGGTCCA<br>GGTGAATCTCCAGGTGGTTCCAGCGGTTCTGAGTCA<br>GGTAGCGAAGGTTCTTCTGGTCCAGGTGAATCCTCA |
| LCW0401_012_<br>GFP-N_H01.ab1 | GSGGEPSESGSSGSGGEP<br>SESGSSGSEGSSGPGESS | GGTTCTGGTGGTGAACCGTCTGAGTCTGGTAGCTCA<br>GGTTCCGGTGGCGAACCATCCGAATCTGGTAGCTCA<br>GGTAGCGAAGGTTCTTCCGGTCCAGGTGAGTCTTCA |
| LCW0401_015_<br>GFP-N_A02.ab1 | GSSESGSSEGGPGSEGSS<br>GPGESSGESPGGSSGSES | GGTTCTTCCGAAAGCGGTTCTTCCGAAGGCGGTCCA<br>GGTAGCGAAGGTTCTTCTGGTCCAGGCGAATCTTCA<br>GGTGAATCTCCTGGTGGCTCCAGCGGTTCTGAGTCA |
| LCW0401_016_<br>GFP-N_B02.ab1 | GSSESGSSEGGPGSSESG<br>SSEGGPGSSESGSSEGGP | GGTTCCTCCGAAAGCGGTTCTTCTGAGGGCGGTCCA<br>GGTTCCTCCGAAAGCGGTTCTTCCGAGGGCGGTCCA<br>GGTTCTTCTGAAAGCGGTTCTTCCGAGGGCGGTCCA |
| LCW0401_020_<br>GFP-N_E02.ab1 | GSGGEPSESGSSGSEGSS<br>GPGESSGSSESGSSEGGP | GGTTCCGGTGGCGAACCGTCCGAATCTGGTAGCTCA<br>GGTAGCGAAGGTTCTTCTGGTCCAGGCGAATCTTCA<br>GGTTCCTCTGAAAGCGGTTCTTCTGAGGGCGGTCCA |
| LCW0401_022_<br>GFP-N_F02.ab1 | GSGGEPSESGSSGSSESG<br>SSEGGPGSGGEPSESGSS | GGTTCTGGTGGCGAACCGTCCGAATCTGGTAGCTCA<br>GGTTCTTCCGAAAGCGGTTCTTCTGAAGGTGGTCCA<br>GGTTCCGGTGGCGAACCTTCTGAATCTGGTAGCTCA |
| LCW0401_024_<br>GFP-N_G02.ab1 | GSGGEPSESGSSGSSESG<br>SSEGGPGESPGGSSGSES | GGTTCTGGTGGCGAACCGTCCGAATCTGGTAGCTCA<br>GGTTCCTCCGAAAGCGGTTCTTCTGAAGGTGGTCCA<br>GGTGAATCTCCAGGTGGTTCTAGCGGTTCTGAATCA |
| LCW0401_026_<br>GFP-N_H02.ab1 | GSGGEPSESGSSGESPGG<br>SSGSESGSEGSSGPGESS | GGTTCTGGTGGCGAACCGTCTGAGTCTGGTAGCTCA<br>GGTGAATCTCCTGGTGGCTCCAGCGGTTCTGAATCA<br>GGTAGCGAAGGTTCTTCTGGTCCTGGTGAATCTTCA |
| LCW0401_027_<br>GFP-N_A03.ab1 | GSGGEPSESGSSGESPGG<br>SSGSESGSGGEPSESGSS | GGTTCCGGTGGCGAACCTTCCGAATCTGGTAGCTCA<br>GGTGAATCTCCGGGTGGTTCTAGCGGTTCTGAGTCA<br>GGTTCTGGTGGTGAACCTTCCGAGTCTGGTAGCTCA |
| LCW0401_028_<br>GFP-N_B03.ab1 | GSSESGSSEGGPGSSESG<br>SSEGGPGSSESGSSEGGP | GGTTCCTCTGAAAGCGGTTCTTCTGAGGGCGGTCCA<br>GGTTCTTCCGAAAGCGGTTCTTCCGAGGGCGGTCCA<br>GGTTCTTCCGAAAGCGGTTCTTCTGAAGGCGGTCCA |
| LCW0401_030_<br>GFP-N_C03.ab1 | GESPGGSSGSESGSEGSS<br>GPGESSGSEGSSGPGESS | GGTGAATCTCCGGGTGGCTCCAGCGGTTCTGAGTCA<br>GGTAGCGAAGGTTCTTCCGGTCCGGGTGAGTCCTCA<br>GGTAGCGAAGGTTCTTCCGGTCCTGGTGAGTCTTCA |
| LCW0401_031_<br>GFP-N_D03.ab1 | GSGGEPSESGSSGSGGEP<br>SESGSSGSSESGSSEGGP | GGTTCTGGTGGCGAACCTTCCGAATCTGGTAGCTCA<br>GGTTCCGGTGGTGAACCTTCTGAATCTGGTAGCTCA<br>GGTTCTTCTGAAAGCGGTTCTTCCGAGGGCGGTCCA |
| LCW0401_033_<br>GFP-N_E03.ab1 | GSGGEPSESGSSGSGGEP<br>SESGSSGSGGEPSESGSS | GGTTCCGGTGGTGAACCTTCTGAATCTGGTAGCTCA<br>GGTTCCGGTGGCGAACCATCCGAATCTGGTAGCTCA<br>GGTTCCGGTGGTGAACCATCCGAGTCTGGTAGCTCA |
| LCW0401_037_<br>GFP-N_F03.ab1 | GSGGEPSESGSSGSSESG<br>SSEGGPGSEGSSGPGESS | GGTTCCGGTGGCGAACCTTCTGAATCTGGTAGCTCA<br>GGTTCCTCCGAAAGCGGTTCTTCTGAGGGCGGTCCA<br>GGTAGCGAAGGTTCTTCTGGTCCGGGCGAGTCTTCA |
| LCW0401_038_<br>GFP-N_G03.ab1 | GSGGEPSESGSSGSEGSS<br>GPGESSGSGGEPSESGSS | GGTTCCGGTGGTGAACCGTCCGAGTCTGGTAGCTCA<br>GGTAGCGAAGGTTCTTCTGGTCCGGGTGAGTCTTCA<br>GGTTCTGGTGGCGAACCGTCCGAATCTGGTAGCTCA |

TABLE 13-continued

DNA and Amino Acid Sequences for AD 36-mer motifs (SEQ ID NOS 203-278, respectively, in order of appearance)

| File name | Amino acid sequence | Nucleotide sequence |
|---|---|---|
| LCW0401_039_<br>GFP-N_H03.ab1 | GSGGEPSESGSSGESPGG<br>SSGSESGSGGEPSESGSS | GGTTCTGGTGGCGAACCGTCCGAATCTGGTAGCTCA<br>GGTGAATCTCCTGGTGGTTCCAGCGGTTCCGAGTCA<br>GGTTCTGGTGGCGAACCTTCCGAATCTGGTAGCTCA |
| LCW0401_040_<br>GFP-N_A04.ab1 | GSSESGSSEGGPGSGGEP<br>SESGSSGSSESGSSEGGP | GGTTCTTCCGAAAGCGGTTCTTCCGAGGGCGGTCCA<br>GGTTCCGGTGGTGAACCATCTGAATCTGGTAGCTCA<br>GGTTCTTCTGAAAGCGGTTCTTCTGAAGGTGGTCCA |
| LCW0401_042_<br>GFP-N_C04.ab1 | GSEGSSGPGESSGESPGG<br>SSGSESGSEGSSGPGESS | GGTAGCGAAGGTTCTTCCGGTCCTGGTGAGTCTTCA<br>GGTGAATCTCCAGGTGGCTCTAGCGGTTCCGAGTCA<br>GGTAGCGAAGGTTCTTCTGGTCCTGGCGAGTCCTCA |
| LCW0401_046_<br>GFP-N_D04.ab1 | GSSESGSSEGGPGSSESG<br>SSEGGPGSSESGSSEGGP | GGTTCCTCTGAAAGCGGTTCTTCCGAAGGCGGTCCA<br>GGTTCTTCCGAAAGCGGTTCTTCTGAGGGCGGTCCA<br>GGTTCCTCCGAAAGCGGTTCTTCTGAGGGTGGTCCA |
| LCW0401_047_<br>GFP-N_E04.ab1 | GSGGEPSESGSSGESPGG<br>SSGSESGESPGGSSGSES | GGTTCTGGTGGCGAACCTTCCGAGTCTGGTAGCTCA<br>GGTGAATCTCCGGGTGGTTCTAGCGGTTCCGAGTCA<br>GGTGAATCTCCGGGTGGTTCCAGCGGTTCTGAGTCA |
| LCW0401_051_<br>GFP-N_F04.ab1 | GSGGEPSESGSSGSEGSS<br>GPGESSGESPGGSSGSES | GGTTCTGGTGGCGAACCATCTGAGTCTGGTAGCTCA<br>GGTAGCGAAGGTTCTTCCGGTCCAGGCGAGTCTTCA<br>GGTGAATCTCCTGGTGGCTCCAGCGGTTCTGAGTCA |
| LCW0401_053_<br>GFP-N_H04.ab1 | GESPGGSSGSESGESPGG<br>SSGSESGESPGGSSGSES | GGTGAATCTCCTGGTGGTTCCAGCGGTTCCGAGTCA<br>GGTGAATCTCCAGGTGGCTCTAGCGGTTCCGAGTCA<br>GGTGAATCTCCTGGTGGTTCTAGCGGTTCTGAATCA |
| LCW0401_054_<br>GFP-N_A05.ab1 | GSEGSSGPGESSGSEGSS<br>GPGESSGSGGEPSESGSS | GGTAGCGAAGGTTCTTCCGGTCCAGGTGAATCTTCA<br>GGTAGCGAAGGTTCTTCTGGTCCTGGTGAATCCTCA<br>GGTTCCGGTGGCGAACCATCTGAATCTGGTAGCTCA |
| LCW0401_059_<br>GFP-N_D05.ab1 | GSGGEPSESGSSGSEGSS<br>GPGESSGESPGGSSGSES | GGTTCTGGTGGCGAACCATCCGAATCTGGTAGCTCA<br>GGTAGCGAAGGTTCTTCTGGTCCTGGCGAATCTTCA<br>GGTGAATCTCCAGGTGGCTCTAGCGGTTCCGAATCA |
| LCW0401_060_<br>GFP-N_E05.ab1 | GSGGEPSESGSSGSSESG<br>SSEGGPGSGGEPSESGSS | GGTTCCGGTGGTGAACCGTCCGAATCTGGTAGCTCA<br>GGTTCCTCTGAAAGCGGTTCTTCCGAGGGTGGTCCA<br>GGTTCCGGTGGTGAACCTTCTGAGTCTGGTAGCTCA |
| LCW0401_061_<br>GFP-N_F05.ab1 | GSSESGSSEGGPGSGGEP<br>SESGSSGSEGSSGPGESS | GGTTCCTCTGAAAGCGGTTCTTCTGAGGGCGGTCCA<br>GGTTCTGGTGGCGAACCATCTGAATCTGGTAGCTCA<br>GGTAGCGAAGGTTCTTCCGGTCCGGGTGAATCTTCA |
| LCW0401_063_<br>GFP-N_H05.ab1 | GSGGEPSESGSSSGSEGSS<br>GPGESSGSEGSSGPGESS | GGTTCTGGTGGTGAACCGTCCGAATCTGGTAGCTCA<br>GGTAGCGAAGGTTCTTCTGGTCCTGGCGAGTCTTCA<br>GGTAGCGAAGGTTCTTCTGGTCCTGGTGAATCTTCA |
| LCW0401_066_<br>GFP-N_B06.ab1 | GSGGEPSESGSSGSSESG<br>SSEGGPGSGGEPSESGSS | GGTTCTGGTGGCGAACCATCCGAGTCTGGTAGCTCA<br>GGTTCTTCCGAAAGCGGTTCTTCCGAAGGCGGTCCA<br>GGTTCTGGTGGTGAACCGTCCGAATCTGGTAGCTCA |
| LCW0401_067_<br>GFP-N_C06.ab1 | GSGGEPSESGSSGESPGG<br>SSGSESGESPGGSSGSES | GGTTCCGGTGGCGAACCTTCCGAATCTGGTAGCTCA<br>GGTGAATCTCCGGGTGGTTCTAGCGGTTCCGAATCA<br>GGTGAATCTCCAGGTGGTTCTAGCGGTTCCGAATCA |
| LCW0401_069_<br>GFP-N_D06.ab1 | GSGGEPSESGSSGSGGEP<br>SESGSSGESPGGSSGSES | GGTTCCGGTGGTGAACCATCTGAGTCTGGTAGCTCA<br>GGTTCCGGTGGCGAACCGTCCGAGTCTGGTAGCTCA<br>GGTGAATCTCCGGGTGGTTCCAGCGGTTCCGAATCA |
| LCW0401_070_<br>GFP-N_E06.ab1 | GSEGSSGPGESSGSSESG<br>SSEGGPGSEGSSGPGESS | GGTAGCGAAGGTTCTTCTGGTCCGGGCGAATCCTCA<br>GGTTCCTCCGAAAGCGGTTCTTCCGAAGGTGGTCCA<br>GGTAGCGAAGGTTCTTCCGGTCCTGGTGAATCTTCA |
| LCW0401_078_<br>GFP-N_F06.ab1 | GSSESGSSEGGPGESPGG<br>SSGSESGESPGGSSGSES | GGTTCCTCTGAAAGCGGTTCTTCTGAAGGCGGTCCA<br>GGTGAATCTCCGGGTGGCTCCAGCGGTTCTGAATCA<br>GGTGAATCTCCTGGTGGCTCCAGCGGTTCCGAGTCA |
| LCW0401_079_<br>GFP-N_G06.ab1 | GSEGSSGPGESSGSEGSS<br>GPGESSGSGGEPSESGSS | GGTAGCGAAGGTTCTTCTGGTCCAGGCGAGTCTTCA<br>GGTAGCGAAGGTTCTTCCGGTCCTGGCGAGTCTTCA<br>GGTTCCGGTGGCGAACCGTCCGAATCTGGTAGCTCA |

Example 2: Construction of XTEN_AE36 Segments

A codon library encoding XTEN sequences of 36 amino acid length was constructed. The XTEN sequence was designated XTEN_AE36. Its segments have the amino acid sequence [α]$_3$ where X is a 12mer peptide with the sequence: GSPAGSPTSTEE (SEQ ID NO: 23), GSEPATSGSETP (SEQ ID NO: 24), GTSESATPESGP (SEQ ID NO: 25), or GTSTEPSEGSAP (SEQ ID NO: 26). The insert was obtained by annealing the following pairs of phosphorylated synthetic oligonucleotide pairs:

```
                                         (SEQ ID NO: 1628)
AE1for: AGGTAGCCCDGCWGGYTCTCCDACYTCYACYGARGA (SEQ ID NO: 1629)
AE1rev: ACCTTCYTCRGTRGARGTHGGAGARCCWGCHGGGCT (SEQ ID NO: 1630)
AE2for: AGGTAGCGAACCKGCWACYTCYGGYTCTGARACYCC (SEQ ID NO: 1631)
AE2rev: ACCTGGRGTYTCAGARCCRGARGTWGCMGGTTCGCT (SEQ ID NO: 1632)
AE3for: AGGTACYTCTGAAAGCGCWACYCCKGARTCYGGYCC (SEQ ID NO: 1633)
AE3rev: ACCTGGRCCRGAYTCMGGRGTWGCGCTTTCAGARGT (SEQ ID NO: 1634)
AE4for: AGGTACYTCTACYGAACCKTCYGARGGYAGCGCWCC (SEQ ID NO: 1635)
AE4rev: ACCTGGWGCGCTRCCYTCRGAMGGTTCRGTAGARGT
```

We also annealed the phosphorylated oligonucleotide 3 KpnIstopperFor: AGGTTCGTCTTCACTCGAGGGTAC (SEQ ID NO: 1626) and the non-phosphorylated oligonucleotide pr_3 KpnIstopperRev: CCTCGAGTGAAGACGA (SEQ ID NO: 1627). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs and the sequences for these segments are listed in Table 14.

TABLE 14

DNA and Amino Acid Sequences for AE 36-mer motifs (SEQ ID NOS 279-352, respectively, in order of appearance)

| File name | Amino acid sequence | Nucleotide sequence |
|---|---|---|
| LCW0402_002_<br>GFP-N_A07.ab1 | GSPAGSPTSTEEGTSE<br>SATPESGPGTSTEPSE<br>GSAP | GGTAGCCCGGCAGGCTCTCCGACCTCTACTGAGGAA<br>GGTACTTCTGAAAGCGCAACCCCGGAGTCCGGCCCA<br>GGTACCTCTACCGAACCGTCTGAGGGCAGCGCACCA |
| LCW0402_003_<br>GFP-N_B07.ab1 | GTSTEPSEGSAPGTST<br>EPSEGSAPGTSTEPSE<br>GSAP | GGTACTTCTACCGAACCGTCCGAAGGCAGCGCTCCA<br>GGTACCTCTACTGAACCTTCCGAGGGCAGCGCTCCA<br>GGTACCTCTACCGAACCTTCTGAAGGTAGCGCACCA |
| LCW0402_004_<br>GFP-N_C07.ab1 | GTSTEPSEGSAPGTSE<br>SATPESGPGTSESATP<br>ESGP | GGTACCTCTACCGAACCGTCTGAAGGTAGCGCACCA<br>GGTACCTCTGAAAGCGCAACTCCTGAGTCCGGTCCA<br>GGTACTTCTGAAAGCGCAACCCCGGAGTCTGGCCCA |
| LCW0402_005_<br>GFP-N_D07.ab1 | GTSTEPSEGSAPGTSE<br>SATPESGPGTSESATP<br>ESGP | GGTACTTCTACTGAACCGTCTGAAGGTAGCGCACCA<br>GGTACTTCTGAAAGCGCAACCCCGGAATCCGGCCCA<br>GGTACCTCTGAAAGCGCAACCCCGGAGTCCGGCCCA |
| LCW0402_006_<br>GFP-N_E07.ab1 | GSEPATSGSETPGTSE<br>SATPESGPGSPAGSPT<br>STEE | GGTAGCGAACCGGCAACCTCCGGCTCTGAAACCCCA<br>GGTACCTCTGAAAGCGCTACTCCTGAATCCGGCCCA<br>GGTAGCCCGGCAGGTTCTCCGACTTCCACTGAGGAA |
| LCW0402_008_<br>GFP-N_F07.ab1 | GTSESATPESGPGSEP<br>ATSGSETPGTSTEPSE<br>GSAP | GGTACTTCTGAAAGCGCAACCCCTGAATCCGGTCCA<br>GGTAGCGAACCGGCTACTTCTGGCTCTGAGACTCCA<br>GGTACTTCTACCGAACCGTCCGAAGGTAGCGCACCA |
| LCW0402_009_<br>GFP-N_G07.ab1 | GSPAGSPTSTEEGSPA<br>GSPTSTEEGSEPATSG<br>SETP | GGTAGCCCGGCTGGCTCTCCAACCTCCACTGAGGAA<br>GGTAGCCCGGCTGGCTCTCCAACCTCCACTGAAGAA<br>GGTAGCGAACCGGCTACCTCCGGCTCTGAAACTCCA |
| LCW0402_011_<br>GFP-N_A08.ab1 | GSPAGSPTSTEEGTSE<br>SATPESGPGTSTEPSE<br>GSAP | GGTAGCCCGGCTGGCTCTCCTACCTCTACTGAGGAA<br>GGTACTTCTGAAAGCGCTACTCCTGAGTCTGGTCCA<br>GGTACCTCTACTGAACCGTCCGAAGGTAGCGCTCCA |
| LCW0402_012_<br>GFP-N_B08.ab1 | GSPAGSPTSTEEGSPA<br>GSPTSTEEGTSTEPSE<br>GSAP | GGTAGCCCTGCTGGCTCTCCGACTTCTACTGAGGAA<br>GGTAGCCCGGCTGGTTCTCCGACTTCTACTGAGGAA<br>GGTACTTCTACCGAACCTTCCGAAGGTAGCGCTCCA |
| LCW0402_013_ | GTSESATPESGPGTST | GGTACTTCTGAAAGCGCTACTCCGGAGTCCGGTCCA |

TABLE 14-continued

DNA and Amino Acid Sequences for AE 36-mer motifs (SEQ ID NOS 279-352, respectively, in order of appearance)

| File name | Amino acid sequence | Nucleotide sequence |
|---|---|---|
| GFP-N_C08.ab1 | EPSEGSAPGTSTEPSE GSAP | GGTACCTCTACCGAACCGTCCGAAGGCAGCGCTCCA GGTACTTCTACTGAACCTTCTGAGGGTAGCGCTCCA |
| LCW0402_014_ GFP-N_D08.ab1 | GTSTEPSEGSAPGSPA GSPTSTEEGTSTEPSE GSAP | GGTACCTCTACCGAACCTTCCGAAGGTAGCGCTCCA GGTAGCCCGGCAGGTTCTCCTACTTCCACTGAGGAA GGTACTTCTACCGAACCTTCTGAGGGTAGCGCACCA |
| LCW0402_015_ GFP-N_E08.ab1 | GSEPATSGSETPGSPA GSPTSTEEGTSESATP ESGP | GGTAGCGAACCGGCTACTTCCGGCTCTGAGACTCCA GGTAGCCCTGCTGGCTCTCCGACCTCTACCGAAGAA GGTACCTCTGAAAGCGCTACCCCTGAGTCTGGCCCA |
| LCW0402_016_ GFP-N_F08.ab1 | GTSTEPSEGSAPGTSE SATPESGPGTSESATP ESGP | GGTACTTCTACCGAACCTTCCGAGGGCAGCGCACCA GGTACTTCTGAAAGCGCTACCCCTGAGTCCGGCCCA GGTACTTCTGAAAGCGCTACTCCTGAATCCGGTCCA |
| LCW0402_020_ GFP-N_G08.ab1 | GTSTEPSEGSAPGSEP ATSGSETPGSPAGSPT STEE | GGTACTTCTACTGAACCGTCTGAAGGCAGCGCACCA GGTAGCGAACCGGCTACTTCCGGTTCTGAAACCCCA GGTAGCCCAGCAGGTTCTCCAACTTCTACTGAAGAA |
| LCW0402_023_ GFP-N_A09.ab1 | GSPAGSPTSTEEGTSE SATPESGPGSEPATSG SETP | GGTAGCCCTGCTGGCTCTCCAACCTCCACCGAAGAA GGTACCTCTGAAAGCGCAACCCCTGAATCCGGCCCA GGTAGCGAACCGGCAACCTCCGGTTCTGAAACCCCA |
| LCW0402_024_ GFP-N_B09.ab1 | GTSESATPESGPGSPA GSPTSTEEGSPAGSPT STEE | GGTACTTCTGAAAGCGCTACTCCTGAGTCCGGCCCA GGTAGCCCGGCTGGCTCTCCGACTTCCACCGAGGAA GGTAGCCCGGCTGGCTCTCCAACTTCTACTGAAGAA |
| LCW0402_025_ GFP-N_C09.ab1 | GTSTEPSEGSAPGTSE SATPESGPGTSTEPSE GSAP | GGTACCTCTACTGAACCTTCTGAGGGCAGCGCTCCA GGTACTTCTGAAAGCGCTACCCCGGAGTCCGGTCCA GGTACTTCTACTGAACCGTCCGAAGGTAGCGCACCA |
| LCW0402_026_ GFP-N_D09.ab1 | GSPAGSPTSTEEGTST EPSEGSAPGSEPATSG SETP | GGTAGCCCGGCAGGCTCTCCGACTTCCACCGAGGAA GGTACCTCTACTGAACCTTCTGAGGGTAGCGCTCCA GGTAGCGAACCGGCAACCTCTGGCTCTGAAACCCCA |
| LCW0402_027_ GFP-N_E09.ab1 | GSPAGSPTSTEEGTST EPSEGSAPGTSTEPSE GSAP | GGTAGCCCAGCAGGCTCTCCGACTTCCACTGAGGAA GGTACTTCTACTGAACCTTCCGAAGGCAGCGCACCA GGTACCTCTACTGAACCTTCTGAGGGCAGCGCTCCA |
| LCW0402_032_ GFP-N_H09.ab1 | GSEPATSGSETPGTSE SATPESGPGSPAGSPT STEE | GGTAGCGAACCTGCTACCTCCGGTTCTGAAACCCCA GGTACCTCTGAAAGCGCAACTCCGGAGTCTGGTCCA GGTAGCCCTGCAGGTTCTCCTACCTCCACTGAGGAA |
| LCW0402_034_ GFP-N_A10.ab1 | GTSESATPESGPGTST EPSEGSAPGTSTEPSE GSAP | GGTACCTCTGAAAGCGCTACTCCGGAGTCTGGCCCA GGTACCTCTACTGAACCGTCTGAGGGTAGCGCTCCA GGTACTTCTACTGAACCGTCCGAAGGTAGCGCACCA |
| LCW0402_036_ GFP-N_C10.ab1 | GSPAGSPTSTEEGTST EPSEGSAPGTSTEPSE GSAP | GGTAGCCCGGCTGGTTCTCCGACTTCCACCGAGGAA GGTACCTCTACTGAACCTTCTGAGGTAGCGCTCCA GGTACCTCTACTGAACCTTCCGAAGGCAGCGCTCCA |
| LCW0402_039_ GFP-N_E10.ab1 | GTSTEPSEGSAPGTST EPSEGSAPGTSTEPSE GSAP | GGTACTTCTACCGAACCGTCCGAGGGCAGCGCTCCA GGTACTTCTACTGAACCTTCTGAAGGCAGCGCTCCA GGTACTTCTACTGAACCTTCCGAAGGTAGCGCACCA |
| LCW0402_040_ GFP-N_F10.ab1 | GSEPATSGSETPGTSE SATPESGPGTSTEPSE GSAP | GGTAGCGAACCTGCAACCTCTGGCTCTGAAACCCCA GGTACCTCTGAAAGCGCTACTCCTGAATCTGGCCCA GGTACTTCTACTGAACCGTCCGAGGGCAGCGCACCA |
| LCW0402_041_ GFP-N_G10.ab1 | GTSTEPSEGSAPGSPA GSPTSTEEGTSTEPSE GSAP | GGTACTTCTACCGAACCGTCCGAGGGTAGCGCACCA GGTAGCCCAGCAGGTTCTCCTACCTCCACCGAGGAA GGTACTTCTACCGAACCGTCCGAGGGTAGCGCACCA |
| LCW0402_050_ GFP-N_A11.ab1 | GSEPATSGSETPGTSE SATPESGPGSEPATSG SETP | GGTAGCGAACCGGCAACCTCCGGCTCTGAAACTCCA GGTACTTCTGAAAGCGCTACTCCGGAATCCGGCCCA GGTAGCGAACCGGCTACTTCCGGCTCTGAAACCCCA |
| LCW0402_051_ GFP-N_B11.ab1 | GSEPATSGSETPGTSE SATPESGPGSEPATSG SETP | GGTAGCGAACCGGCAACTTCCGGCTCTGAAACCCCA GGTACTTCTGAAAGCGCTACTCCTGAGTCTGGCCCA GGTAGCGAACCTGCTACCTCTGGCTCTGAAACCCCA |
| LCW0402_059_ GFP-N_E11.ab1 | GSEPATSGSETPGSEP ATSGSETPGTSTEPSE GSAP | GGTAGCGAACCGGCAACCTCCGGCTCTGAAACTCCA GGTAGCGAACCTGCAACCTCCGGCTCTGAAACCCCA GGTACTTCTACTGAACCTTCTGAGGGCAGCGCACCA |

TABLE 14-continued

DNA and Amino Acid Sequences for AE 36-mer motifs (SEQ ID NOS 279-352, respectively, in order of appearance)

| File name | Amino acid sequence | Nucleotide sequence |
|---|---|---|
| LCW0402_060_GFP-N_F11.ab1 | GTSESATPESGPGSEP ATSGSETPGSEPATSG SETP | GGTACTTCTGAAAGCGCTACCCCGGAATCTGGCCCA GGTAGCGAACCGGCTACTTCTGGTTCTGAAACCCCA GGTAGCGAACCGGCTACCTCCGGTTCTGAAACTCCA |
| LCW0402_061_GFP-N_G11.ab1 | GTSTEPSEGSAPGTST EPSEGSAPGTSESATP ESGP | GGTACCTCTACTGAACCTTCCGAAGGCAGCGCTCCA GGTACCTCTACCGAACCGTCCGAGGGCAGCGCACCA GGTACTTCTGAAAGCGCAACCCCTGAATCCGGTCCA |
| LCW0402_065_GFP-N_A12.ab1 | GSEPATSGSETPGTSE SATPESGPGTSESATP ESGP | GGTAGCGAACCGGCAACCTCTGGCTCTGAAACCCCA GGTACCTCTGAAAGCGCTACTCCGGAATCTGGTCCA GGTACTTCTGAAAGCGCTACTCCGGAATCCGGTCCA |
| LCW0402_066_GFP-N_B12.ab1 | GSEPATSGSETPGSEP ATSGSETPGTSTEPSE GSAP | GGTAGCGAACCTGCTACCTCCGGCTCTGAAACTCCA GGTAGCGAACCGGCTACTTCCGGTTCTGAAACTCCA GGTACCTCTACCGAACCTTCCGAAGGCAGCGCACCA |
| LCW0402_067_GFP-N_C12.ab1 | GSEPATSGSETPGTST EPSEGSAPGSEPATSG SETP | GGTAGCGAACCTGCTACTTCTGGTTCTGAAACTCCA GGTACTTCTACCGAACCGTCCGAGGGTAGCGCTCCA GGTAGCGAACCTGCTACTTCTGGTTCTGAAACTCCA |
| LCW0402_069_GFP-N_D12.ab1 | GTSTEPSEGSAPGTST EPSEGSAPGSEPATSG SETP | GGTACCTCTACCGAACCGTCCGAGGGTAGCGCACCA GGTACCTCTACTGAACCGTCTGAGGGTAGCGCTCCA GGTAGCGAACCGGCAACCTCCGGTTCTGAAACTCCA |
| LCW0402_073_GFP-N_F12.ab1 | GTSTEPSEGSAPGSEP ATSGSETPGSPAGSPT STEE | GGTACTTCTACTGAACCTTCCGAAGGTAGCGCTCCA GGTAGCGAACCTGCTACTTCTGGTTCTGAAACCCCA GGTAGCCCGGCTGGCTCTCCGACCTCCACCGAGGAA |
| LCW0402_074_GFP-N_G12.ab1 | GSEPATSGSETPGSPA GSPTSTEEGTSESATP ESGP | GGTAGCGAACCGGCTACTTCCGGCTCTGAGACTCCA GGTAGCCCAGCTGGTTCTCCAACCTCTACTGAGGAA GGTACTTCTGAAAGCGCTACCCCTGAATCTGGTCCA |
| LCW0402_075_GFP-N_H12.ab1 | GTSESATPESGPGSEP ATSGSETPGTSESATP ESGP | GGTACCTCTGAAAGCGCAACTCCTGAGTCTGGCCCA GGTAGCGAACCTGCTACCTCCGGCTCTGAGACTCCA GGTACCTCTGAAAGCGCAACCCCGGAATCTGGTCCA |

Example 3: Construction of XTEN_AF36 Segments

A codon library encoding sequences of 36 amino acid length was constructed. The sequences were designated XTEN_AF36. Its segments have the amino acid sequence [X]$_3$ where X is a 12mer peptide with the sequence: GST-SESPSGTAP (SEQ ID NO: 27), GTSTPESGSASP (SEQ ID NO: 28), GTSPSGESSTAP (SEQ ID NO: 29), or GSTSS-TAESPGP (SEQ ID NO: 30). The insert was obtained by annealing the following pairs of phosphorylated synthetic oligonucleotide pairs:

```
                                    (SEQ ID NO: 1636)
AF1for: AGGTTCTACYAGCGAATCYCCKTCTGGYACYGCWCC (SEQ ID NO: 1637)
AF1rev: ACCTGGWGCRGTRCCAGAMGGRGATTCGCTRGTAGA (SEQ ID NO: 1638)
AF2for: AGGTACYTCTACYCCKGAAAGCGGYTCYGCWTCTCC (SEQ ID NO: 1639)
AF2rev: ACCTGGAGAWGCRGARCCGCTTTCMGGRGTAGARGT (SEQ ID NO: 1640)
AF3for: AGGTACYTCYCCKAGCGGYGAATCTTCTACYGCWCC (SEQ ID NO: 1641)
AF3rev: ACCTGGWGCRGTAGAAGATTCRCCGCTMGGRGARGT (SEQ ID NO: 1642)
AF4for: AGGTTCYACYAGCTCTACYGCWGAATCTCCKGGYCC
```

```
                                    (SEQ ID NO: 1643)
AF4rev: ACCTGGRCCMGGAGATTCWGCRGTAGAGCTRGTRGA
```

We also annealed the phosphorylated oligonucleotide 3 KpnIstopperFor: AGGTTCGTCTTCACTCGAGGGTAC (SEQ ID NO: 1626) and the non-phosphorylated oligonucleotide pr_3 KpnIstopperRev: CCTCGAGTGAAGACGA (SEQ ID NO: 1627). The annealed oligonucleotide pairs were ligated, which resulted in a mixture of products with varying length that represents the varying number of 12mer repeats ligated to one BbsI/KpnI segment The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs and the sequences for these segments are listed in Table 15.

TABLE 15

DNA and Amino Acid Sequences for AF 36-mer motifs (SEQ ID NOS 353-440, respectively, in order of appearance)

| File name | Amino acid sequence | Nucleotide sequence |
|---|---|---|
| LCW0403_004_GFP-N_A01.ab1 | GTSTPESGSASPGTSPSGESSTAPGTSPSGESSTAP | GGTACTTCTACTCCGGAAAGCGGTTCCGCATCTCCAGGTACTTCTCCTAGCGGTGAATCTTCTACTGCTCCAGGTACCTCTCCTAGCGGCGAATCTTCTACTGCTCCA |
| LCW0403_005_GFP-N_B01.ab1 | GTSPSGESSTAPGSTSSTAESPGPGTSPSGESSTAP | GGTACTTCTCCGAGCGGTGAATCTTCTACCGCACCAGGTTCTACTAGCTCTACCGCTGAATCTCCGGGCCCAGGTACTTCTCCGAGCGGTGAATCTTCTACTGCTCCA |
| LCW0403_006_GFP-N_C01.ab1 | GSTSSTAESPGPGTSPSGESSTAPGTSTPESGSASP | GGTTCCACCAGCTCTACTGCTGAATCTCCTGGTCCAGGTACCTCTCCTAGCGGTGAATCTTCTACTGCTCCAGGTACTTCTACTCCTGAAAGCGGTCTGCTTCTCCA |
| LCW0403_007_GFP-N_D01.ab1 | GSTSSTAESPGPGSTSSTAESPGPGTSPSGESSTAP | GGTTCTACCAGCTCTACTGCAGAATCTCCTGGCCCAGGTTCCACCAGCTCTACCGCAGAATCTCCGGGTCCAGGTACTTCCCCTAGCGGTGAATCTTCTACCGCACCA |
| LCW0403_008_GFP-N_E01.ab1 | GSTSSTAESPGPGTSPSGESSTAPGTSTPESGSASP | GGTTCTACTAGCTCTACTGCTGAATCTCCTGGCCCAGGTACTTCTCCTAGCGGTGAATCTTCTACCGCTCCAGGTACCTCTACTCCGGAAAGCGGTTCTGCATCTCCA |
| LCW0403_010_GFP-N_F01.ab1 | GSTSSTAESPGPGTSTPESGSASPGSTSESPSGTAP | GGTTCTACCAGCTCTACCGCAGAATCTCCTGGTCCAGGTACCTCTACTCCGGAAAGCGGCTCTGCATCTCCAGGTTCTACTAGCGAATCTCCTTCTGGCACTGCACCA |
| LCW0403_011_GFP-N_G01.ab1 | GSTSSTAESPGPGTSTPESGSASPGTSTPESGSASP | GGTTCTACTAGCTCTACTGCAGAATCTCCTGGCCCAGGTACCTCTACTCCGGAAAGCGGCTCTGCATCTCCAGGTACTTCTACCCCTGAAAGCGGTTCTGCATCTCCA |
| LCW0403_012_GFP-N_H01.ab1 | GSTSESPSGTAPGTSPSGESSTAPGSTSESPSGTAP | GGTTCTACCAGCGAATCTCCTTCTGGCACCGCTCCAGGTACCTCTCCTAGCGGCGAATCTTCTACCGCTCCAGGTTCTACTAGCGAATCTCCTTCTGGCACTGCACCA |
| LCW0403_013_GFP-N_A02.ab1 | GSTSSTAESPGPGSTSSTAESPGPGTSPSGESSTAP | GGTTCCACCAGCTCTACTGCAGAATCTCCGGGCCCAGGTTCTACTAGCTCTACTGCAGAATCTCCGGGTCCAGGTACTTCTCCTAGCGGCGAATCTTCTACCGCTCCA |
| LCW0403_014_GFP-N_B02.ab1 | GSTSSTAESPGPGTSTPESGSASPGSTSESPSGTAP | GGTTCCACTAGCTCTACTGCAGAATCTCCTGGCCCAGGTACCTCTACCCCTGAAAGCGGCTCTGCATCTCCAGGTTCTACCAGCGAATCCCCGTCTGGCACCGCACCA |
| LCW0403_015_GFP-N_C02.ab1 | GSTSSTAESPGPGSTSSTAESPGPGTSPSGESSTAP | GGTTCTACTAGCTCTACTGCTGAATCTCCGGGTCCAGGTTCTACCAGCTCTACTGCTGAATCTCCTGGTCCAGGTACCTCCCCGAGCGGTGAATCTTCTACTGCACCA |
| LCW0403_017_GFP-N_D02.ab1 | GSTSSTAESPGPGSTSESPSGTAPGSTSSTAESPGP | GGTTCTACCAGCTCTACCGCTGAATCTCCTGGCCCAGGTTCTACCAGCGAATCCCCGTCTGGCACCGCACCAGGTTCTACTAGCTCTACCGCTGAATCTCCGGGTCCA |
| LCW0403_018_GFP-N_E02.ab1 | GSTSSTAESPGPGSTSSTAESPGPGSTSSTAESPGP | GGTTCTACCAGCTCTACCGCAGAATCTCCTGGCCCAGGTTCCACTAGCTCTACCGCTGAATCTCCTGGTCCAGGTTCTACTAGCTCTACCGCTGAATCTCCTGGTCCA |
| LCW0403_019_GFP-N_F02.ab1 | GSTSESPSGTAPGSTSSTAESPGPGSTSSTAESPGP | GGTTCTACTAGCGAATCCCCTTCTGGTACTGCTCCAGGTTCCACTAGCTCTACCGCTGAATCTCCTGGCCCAGGTTCCACTAGCTCTACTGCAGAATCTCCTGGTCCA |
| LCW0403_023_GFP-N_H02.ab1 | GSTSESPSGTAPGSTSESPSGTAPGSTSESPSGTAP | GGTTCTACTAGCGAATCTCCTTCTGGTACCGCTCCAGGTTCTACCAGCGAATCCCCGTCTGGTACTGCTCCAGGTTCTACCAGCGAATCTCCTTCTGGTACTGCACCA |
| LCW0403_024_GFP-N_A03.ab1 | GSTSSTAESPGPGSTSSTAESPGPGSTSSTAESPGP | GGTTCCACCAGCTCTACTGCTGAATCTCCTGGCCCAGGTTCTACCAGCTCTACTGCTGAATCTCCGGGCCCAGGTTCCACCAGCTCTACCGCTGAATCTCCGGGTCCA |
| LCW0403_025_GFP-N_B03.ab1 | GSTSSTAESPGPGSTSSTAESPGPGTSPSGESSTAP | GGTTCCACTAGCTCTACCGCAGAATCTCCTGGTCCAGGTTCTACTAGCTCTACTGCTGAATCTCCGGGTCCAGGTACCTCCCCTAGCGGCGAATCTTCTACCGCTCCA |
| LCW0403_028_GFP-N_D03.ab1 | GSSPSASTGTGPGSSTPSGATGSPGSSTPSGATGSP | GGTTCTAGCCCTTCTGCTTCCACCGGTACCGGCCCAGGTAGCTCTACCGTCTGGTGCAACTGGCTCTCCAGGTAGCTCTACTCCGTCTGGTGCAACCGGCTCCCCA |
| LCW0403_029_GFP-N_E03.ab1 | GTSPSGESSTAPGTSTPESGSASPGSTSSTAESPGP | GGTACTTCCCCTAGCGGTGAATCTTCTACTGCTCCAGGTACCTCTACTCCGGAAAGCGGCTCCGCATCTCCAGGTTCTACTAGCTCTACTGCTGAATCTCCTGGTCCA |

TABLE 15-continued

DNA and Amino Acid Sequences for AF 36-mer motifs (SEQ ID NOS 353-440, respectively, in order of appearance)

| File name | Amino acid sequence | Nucleotide sequence |
|---|---|---|
| LCW0403_030_GFP-N_F03.ab1 | GSTSSTAESPGPGSTS STAESPGPGTSTPESG SASP | GGTTCTACTAGCTCTACCGCTGAATCTCCGGGTCCAG GTTCTACCAGCTCTACTGCAGAATCTCCTGGCCCAGG TACTTCTACTCCGGAAAGCGGTTCCGCTTCTCCA |
| LCW0403_031_GFP-N_G03.ab1 | GTSPSGESSTAPGSTS STAESPGPGTSTPESG SASP | GGTACTTCTCCTAGCGGTGAATCTTCTACCGCTCCAG GTTCTACCAGCTCTACTGCTGAATCTCCTGGCCCAGG TACTTCTACCCCGGAAAGCGGCTCCGCTTCTCCA |
| LCW0403_033_GFP-N_H03.ab1 | GSTSESPSGTAPGSTS STAESPGPGTSTSSTAE SPGP | GGTTCTACTAGCGAATCCCCTTCTGGTACTGCACCAG GTTCTACCAGCTCTACTGCTGAATCTCCGGGCCCAGG TTCCACCAGCTCTACCGCAGAATCTCCTGGTCCA |
| LCW0403_035_GFP-N_A04.ab1 | GSTSSTAESPGPGSTS ESPSGTAPGSTSSTAE SPGP | GGTTCCACCAGCTCTACCGCTGAATCTCCGGGCCCA GGTTCTACCAGCGAATCCCCTTCTGGCACTGCACCA GGTTCTACTAGCTCTACCGCAGAATCTCCGGGCCCA |
| LCW0403_036_GFP-N_B04.ab1 | GSTSSTAESPGPGTSP SGESSTAPGTSTPESG SASP | GGTTCTACCAGCTCTACTGCTGAATCTCCGGGTCCAG GTACTTCCCCGAGCGGTGAATCTTCTACTGCACCAG GTACTTCTACTCCGGAAAGCGGTTCCGCTTCTCCA |
| LCW0403_039_GFP-N_C04.ab1 | GSTSESPSGTAPGSTS ESPSGTAPGTSPSGES STAP | GGTTCTACCAGCGAATCTCCTTCTGGCACCGCTCCAG GTTCTACTAGCGAATCCCCGTCTGGTACCGCACCAG GTACTTCTCCTAGCGGCGAATCTTCTACCGCACCA |
| LCW0403_041_GFP-N_D04.ab1 | GSTSESPSGTAPGSTS ESPSGTAPGTSPESG SASP | GGTTCTACCAGCGAATCCCCTTCTGGTACTGCTCCAG GTTCTACCAGCGAATCCCCTTCTGGCACCGCACCAG GTACTTCTACCCCTGAAAGCGGCTCCGCTTCTCCA |
| LCW0403_044_GFP-N_E04.ab1 | GTSTPESGSASPGSTS STAESPGPGSTSSTAE SPGP | GGTACCTCTACTCCTGAAAGCGGTTCTGCATCTCCAG GTTCCACTAGCTCTACCGCAGAATCTCCGGGCCCAG GTTCTACTAGCTCTACTGCTGAATCTCCTGGCCCA |
| LCW0403_046_GFP-N_F04.ab1 | GSTSESPSGTAPGSTS ESPSGTAPGTSPSGES STAP | GGTTCTACCAGCGAATCCCCTTCTGGCACTGCACCA GGTTCTACTAGCGAATCCCCTTCTGGTACCGCACCAG GTACTTCTCCGAGCGGCGAATCTTCTACTGCTCCA |
| LCW0403_047_GFP-N_G04.ab1 | GSTSSTAESPGPGSTS STAESPGPGTSESPS GTAP | GGTTCTACTAGCTCTACCGCTGAATCTCCTGGCCCAG GTTCCACTAGCTCTACCGCAGAATCTCCGGGCCCAG GTTCTACTAGCGAATCCCCTTCTGGTACCGCTCCA |
| LCW0403_049_GFP-N_H04.ab1 | GSTSSTAESPGPGSTS STAESPGPGTSTPESG SASP | GGTTCCACCAGCTCTACTGCAGAATCTCCTGGCCCA GGTTCTACTAGCTCTACCGCAGAATCTCCTGGTCCAG GTACCTCTACTCCTGAAAGCGGTTCCGCATCTCCA |
| LCW0403_051_GFP-N_A05.ab1 | GSTSSTAESPGPGSTS STAESPGPGTSESPS GTAP | GGTTCTACTAGCTCTACTGCTGAATCTCCGGGCCCAG GTTCTACTAGCTCTACCGCTGAATCTCCGGGTCCAGG TTCTACTAGCGAATCCCCTTCTGGTACCGCTCCA |
| LCW0403_053_GFP-N_B05.ab1 | GTSPSGESSTAPGSTS ESPSGTAPGSTSSTAE SPGP | GGTACCTCCCCGAGCGGTGAATCTTCTACTGCACCA GGTTCTACTAGCGAATCCCCTTCTGGTACTGCTCCAG GTTCCACCAGCTCTACTGCAGAATCTCCGGGTCCA |
| LCW0403_054_GFP-N_C05.ab1 | GSTSESPSGTAPGTSP SGESSTAPGSTSSTAE SPGP | GGTTCTACTAGCGAATCCCCGTCTGGTACTGCTCCAG GTACTTCCCCTAGCGGTGAATCTTCTACTGCTCCAGG TTCTACCAGCTCTACCGCAGAATCTCCGGGTCCA |
| LCW0403_057_GFP-N_D05.ab1 | GSTSSTAESPGPGSTS ESPSGTAPGTSPSGES STAP | GGTTCTACCAGCTCTACCGCTGAATCTCCTGGCCCAG GTTCTACTAGCGAATCTCCGTCTGGCACCGCACCAG GTACTTCCCCTAGCGGTGAATCTTCTACTGCACCA |
| LCW0403_058_GFP-N_E05.ab1 | GSTSESPSGTAPGSTS ESPSGTAPGTSTPESG SASP | GGTTCTACTAGCGAATCTCCTTCTGGCACTGCACCAG GTTCTACCAGCGAATCTCCGTCTGGCACTGCACCAG GTACCTCTACCCCTGAAAGCGGTTCCGCTTCTCCA |
| LCW0403_060_GFP-N_F05.ab1 | GTSTPESGSASPGSTS ESPSGTAPGSTSSTAE SPGP | GGTACCTCTACTCCGGAAAGCGGTTCCGCATCTCCA GGTTCTACCAGCGAATCCCCGTCTGGCACCGCACCA GGTTCTACTAGCTCTACTGCTGAATCTCCGGGCCCA |
| LCW0403_063_GFP-N_G05.ab1 | GSTSSTAESPGPGTSP SGESSTAPGTSPSGES STAP | GGTTCTACTAGCTCTACTGCAGAATCTCCGGGCCCA GGTACCTCTCCTAGCGGTGAATCTTCTACCGCTCCAG GTACTTCTCCGAGCGGTGAATCTTCTACCGCTCCA |

TABLE 15-continued

DNA and Amino Acid Sequences for AF 36-mer motifs (SEQ ID NOS 353-440, respectively, in order of appearance)

| File name | Amino acid sequence | Nucleotide sequence |
|---|---|---|
| LCW0403_064_GFP-N_H05.ab1 | GTSPSGESSTAPGTSP SGESSTAPGTSPSGES STAP | GGTACCTCCCCTAGCGGCGAATCTTCTACTGCTCCAG GTACCTCTCCTAGCGGCGAATCTTCTACCGCTCCAGG TACCTCCCCTAGCGGTGAATCTTCTACCGCACCA |
| LCW0403_065_GFP-N_A06.ab1 | GSTSSTAESPGPGTST PESGSASPGSTSESPS GTAP | GGTTCCACTAGCTCTACTGCTGAATCTCCTGGCCCAG GTACTTCTACTCCGGAAAGCGGTTCCGCTTCTCCAGG TTCTACTAGCGAATCTCCGTCTGGCACCGCACCA |
| LCW0403_066_GFP-N_B06.ab1 | GSTSESPSGTAPGTSP SGESSTAPGTSPSGES STAP | GGTTCTACTAGCGAATCTCCGTCTGGCACTGCTCCAG GTACTTCTCCTAGCGGTGAATCTTCTACCGCTCCAGG TACTTCCCCTAGCGGCGAATCTTCTACCGCTCCA |
| LCW0403_067_GFP-N_C06.ab1 | GSTSESPSGTAPGTST PESGSASPGSTSSTAE SPGP | GGTTCTACTAGCGAATCTCCTTCTGGTACCGCTCCAG GTACTTCTACCCCTGAAAGCGGCTCCGCTTCTCCAGG TTCCACTAGCTCTACCGCTGAATCTCCGGGTCCA |
| LCW0403_068_GFP-N_D06.ab1 | GSTSSTAESPGPGSTS STAESPGPGSTSESPS GTAP | GGTTCCACTAGCTCTACTGCTGAATCTCCTGGCCCAG GTTCTACCAGCTCTACCGCTGAATCTCCTGGCCCAGG TTCTACCAGCGAATCTCCGTCTGGCACCGCACCA |
| LCW0403_069_GFP-N_E06.ab1 | GSTSESPSGTAPGTST PESGSASPGTSTPESG SASP | GGTTCTACTAGCGAATCCCCGTCTGGTACCGCACCA GGTACTTCTACCCCGGAAAGCGGCTCTGCTTCTCCAG GTACTTCTACCCCGGAAAGCGGCTCCGCATCTCCA |
| LCW0403_070_GFP-N_F06.ab1 | GSTSESPSGTAPGTST PESGSASPGTSTPESG SASP | GGTTCTACTAGCGAATCCCCGTCTGGTACTGCTCCAG GTACTTCTACTCCTGAAAGCGGTTCCGCTTCTCCAGG TACCTCTACTCCGGAAAGCGGTTCTGCATCTCCA |

Example 4: Construction of XTEN_AG36 Segments

A codon library encoding sequences of 36 amino acid length was constructed. The sequences were designated XTEN_AG36. Its segments have the amino acid sequence [X]$_3$ where X is a 12mer peptide with the sequence: GTPGS-GTASSSP (SEQ ID NO: 31), GSSTPSGATGSP (SEQ ID NO: 32), GSSPSASTGTGP (SEQ ID NO: 33), or GASPGTSSTGSP (SEQ ID NO: 34). The insert was obtained by annealing the following pairs of phosphorylated synthetic oligonucleotide pairs:

```
AG1for:
                                   (SEQ ID NO: 1644)
AGGTACYCCKGGYAGCGGTACYGCWTCTTCYTCTCC AG1rev:
                                   (SEQ ID NO: 1645)
ACCTGGAGARGAAGAWGCRGTACCGCTRCCMGGRGT AG2for:
                                   (SEQ ID NO: 1646)
AGGTAGCTCTACYCCKTCTGGTGCWACYGGYTCYCC AG2rev:
                                   (SEQ ID NO: 1647)
ACCTGGRGARCCRGTWGCACCAGAMGGRGTAGAGCT AG3for:
                                   (SEQ ID NO: 1648)
AGGTTCTAGCCCKTCTGCWTCYACYGGTACYGGYCC AG3rev:
                                   (SEQ ID NO: 1649)
ACCTGGRCCRGTACCRGTRGAWGCAGAMGGGCTAGA
```

```
AG4for:
                                   (SEQ ID NO: 1650)
AGGTGCWTCYCCKGGYACYAGCTCTACYGGTTCTCC AG4rev:
                                   (SEQ ID NO: 1651)
ACCTGGAGAACCRGTAGAGCTRGTRCCMGGRGAWGC
```

We also annealed the phosphorylated oligonucleotide 3 KpnIstopperFor: AGGTTCGTCTTCACTCGAGGGTAC (SEQ ID NO: 1626) and the non-phosphorylated oligonucleotide pr_3 KpnIstopperRev: CCTCGAGTGAAGACGA (SEQ ID NO: 1627). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs and the sequences for these segments are listed in Table 16.

TABLE 16

DNA and Amino Acid Sequences for AG 36-mer motifs (SEQ ID NOS 441-528, respectively, in order of appearance)

| File name | Amino acid sequence | Nucleotide sequence |
|---|---|---|
| LCW0404_001_GFP-N_A07.ab1 | GASPGTSSTGSPGTPGS GTASSSPGSSTPSGATG SP | GGTGCATCCCCGGGCACTAGCTCTACCGGTTCTCCA GGTACTCCTGGTAGCGGTACTGCTTCTTCTTCTCCAG GTAGCTCTACTCCTTCTGGTGCTACTGGTTCTCCA |
| LCW0404_003_GFP-N_B07.ab1 | GSSTPSGATGSPGSSPS ASTGTGPGSSTPSGATG SP | GGTAGCTCTACCCCTTCTGGTGCTACCGGCTCTCCAG GTTCTAGCCCGTCTGCTTCTACCGGTACCGGTCCAGG TAGCTCTACCCCTTCTGGTGCTACTGGTTCTCCA |
| LCW0404_006_GFP-N_C07.ab1 | GASPGTSSTGSPGSSPS ASTGTGPGSSTPSGATG SP | GGTGCATCTCCGGGTACTAGCTCTACCGGTTCTCCAG GTTCTAGCCCTTCTGCTTCCACTGGTACCGGCCCAGG TAGCTCTACCCCGTCTGGTGCTACTGGTTCCCCA |
| LCW0404_007_GFP-N_D07.ab1 | GTPGSGTASSSPGSSTPS GATGSPGASPGTSSTGS P | GGTACTCCGGGCAGCGGTACTGCTTCTTCCTCTCCAG GTAGCTCTACCCCTTCTGGTGCAACTGGTTCCCCAGG TGCATCCCCTGGTACTAGCTCTACCGGTTCTCCA |
| LCW0404_009_GFP-N_E07.ab1 | GTPGSGTASSSPGASPG TSSTGSPGSRPSASTGT GP | GGTACCCCTGGCAGCGGTACTGCTTCTTCTTCTCCAG GTGCTTCCCCTGGTACCAGCTCTACCGGTTCTCCAGG TTCTAGACCTTCTGCATCCACCGGTACTGGTCCA |
| LCW0404_011_GFP-N_F07.ab1 | GASPGTSSTGSPGSSTPS GATGSPGASPGTSSTGS P | GGTGCATCTCCTGGTACCAGCTCTACCGGTTCTCCAG GTAGCTCTACTCCTTCTGGTGCTACTGGCTCTCCAGG TGCTTCCCCGGGTACCAGCTCTACCGGTTCTCCA |
| LCW0404_012_GFP-N_G07.ab1 | GTPGSGTASSSPGSSTPS GATGSPGSSTPSGATGS P | GGTACCCCGGGCAGCGGTACCGCATCTTCCTCTCCA GGTAGCTCTACCCCGTCTGGTGCTACCGGTTCCCCAG GTAGCTCTACCCCGTCTGGTGCAACCGGCTCCCCA |
| LCW0404_014_GFP-N_H07.ab1 | GASPGTSSTGSPGASPG TSSTGSPGASPGTSSTGS P | GGTGCATCTCCGGGCACTAGCTCTACTGGTTCTCCAG GTGCATCCCTGGCACTAGCTCTACTGGTTCTCCAGG TGCTTCTCCTGGTACCAGCTCTACTGGTTCTCCA |
| LCW0404_015_GFP-N_A08.ab1 | GSSTPSGATGSPGSSPS ASTGTGPGASPGTSSTG SP | GGTAGCTCTACTCCGTCTGGTGCAACCGGCTCCCCA GGTTCTAGCCCGTCTGCTTCCACTGGTACTGGCCCAG GTGCTTCCCCGGGCACCAGCTCTACTGGTTCTCCA |
| LCW0404_016_GFP-N_B08.ab1 | GSSTPSGATGSPGSSTPS GATGSPGTPGSGTASSS P | GGTAGCTCTACTCCTTCTGGTGCTACCGGTTCCCCAG GTAGCTCTACTCCTTCTGGTGCTACTGGTTCCCCAGG TACTCCGGGCAGCGGTACTGCTTCTTCCTCTCCA |
| LCW0404_017_GFP-N_C08.ab1 | GSSTPSGATGSPGSSTPS GATGSPGASPGTSSTGS P | GGTAGCTCTACTCCGTCTGGTGCAACCGGTTCCCCAG GTAGCTCTACTCCTTCTGGTGCTACTGGCTCCCCAGG TGCATCCCCTGGCACCAGCTCTACCGGTTCTCCA |
| LCW0404_018_GFP-N_D08.ab1 | GTPGSGTASSSPGSSPS ASTGTGPGSSTPSGATG SP | GGTACTCCTGGTAGCGGTACCGCATCTTCCTCTCCAG GTTCTAGCCCTTCTGCATCTACCGGTACCGGTCCAGG TAGCTCTACTCCTTCTGGTGCTACTGGCTCTCCA |
| LCW0404_023_GFP-N_F08.ab1 | GASPGTSSTGSPGSSPS ASTGTGPGTPGSGTASS SP | GGTGCTTCCCCGGGCACTAGCTCTACCGGTTCTCCAG GTTCTAGCCCTTCTGCATCTACTGGTACTGGCCCAGG TACTCCGGGCAGCGGTACTGCTTCTTCCTCTCCA |
| LCW0404_025_GFP-N_G08.ab1 | GSSTPSGATGSPGSSTPS GATGSPGASPGTSSTGS P | GGTAGCTCTACTCCGTCTGGTGCTACCGGCTCTCCAG GTAGCTCTACCCCTTCTGGTGCAACCGGCTCCCCAGG TGCTTCTCCGGGTACCAGCTCTACTGGTTCTCCA |
| LCW0404_029_GFP-N_A09.ab1 | GTPGSGTASSSPGSSTPS GATGSPGSSPSASTGTG P | GGTACCCCTGGCAGCGGTACCGCTTCTTCCTCTCCAG GTAGCTCTACCCCGTCTGGTGCTACTGGCTCTCCAGG TTCTAGCCCGTCTGCATCTACCGGTACCGGCCCA |
| LCW0404_030_GFP-N_B09.ab1 | GSSTPSGATGSPGTPGS GTASSSPGTPGSGTASS SP | GGTAGCTCTACTCCTTCTGGTGCAACCGGCTCCCAG GTACCCCGGGCAGCGGTACCGCATCTTCCTCTCCAG GTACTCCGGGTAGCGGTACTGCTTCTTCTTCTCCA |
| LCW0404_031_GFP-N_C09.ab1 | GTPGSGTASSSPGSSTPS GATGSPGASPGTSSTGS P | GGTACCCCGGGTAGCGGTACTGCTTCTTCCTCTCCAG GTAGCTCTACCCCTTCTGGTGCAACCGGCTCTCCAGG TGCTTCTCCGGGCACCAGCTCTACCGGTTCTCCA |
| LCW0404_034_GFP-N_D09.ab1 | GSSTPSGATGSPGSSTPS GATGSPGASPGTSSTGS P | GGTAGCTCTACCCCGTCTGGTGCTACCGGCTCTCCAG GTAGCTCTACCCCGTCTGGTGCAACCGGCTCCCCAG GTGCATCCCCGGGTACTAGCTCTACCGGTTCTCCA |
| LCW0404_035_GFP-N_E09.ab1 | GASPGTSSTGSPGTPGS GTASSSPGSSTPSGATG SP | GGTGCTTCTCCGGGCACCAGCTCTACTGGTTCTCCAG GTACCCCGGGCAGCGGTACCGCATCTTCTTCTCCAG GTAGCTCTACTCCTTCTGGTGCAACTGGTTCTCCA |

TABLE 16-continued

DNA and Amino Acid Sequences for AG 36-mer motifs (SEQ ID NOS 441-528, respectively, in order of appearance)

| File name | Amino acid sequence | Nucleotide sequence |
|---|---|---|
| LCW0404_036_GFP-N_F09.ab1 | GSSPSASTGTPGSSTPSGATGSPGTPGSGTASSSP | GGTTCTAGCCCGTCTGCTTCCACCGGTACTGGCCCAGGTAGCTCTACCCCGTCTGGTGCAACTGGTTCCCCAGGTACCCCTGGTAGCGGTACCGCTTCTTCTTCTCCA |
| LCW0404_037_GFP-N_G09.ab1 | GASPGTSSTGSPGSSPSASTGTGPGSSTPSGATGSP | GGTGCTTCTCCGGGCACCAGCTCTACTGGTTCTCCAGGTTCTAGCCCTTCTGCATCCACCGGTACCGGTCCAGGTAGCTCTACCCCTTCTGGTGCAACCGGCTCTCCA |
| LCW0404_040_GFP-N_H09.ab1 | GASPGTSSTGSPGSSTPSGATGSPGSSTPSGATGSP | GGTGCATCCCCGGGCACCAGCTCTACCGGTTCTCCAGGTAGCTCTACCCCGTCTGGTGCTACCGGCTCTCCAGGTAGCTCTACCCCGTCTGGTGCTACTGGCTCTCCA |
| LCW0404_041_GFP-N_A10.ab1 | GTPGSGTASSSPGSSTPSGATGSPGTPGSGTASSSP | GGTACCCCTGGTAGCGGTACTGCTTCTTCCTCTCCAGGTAGCTCTACTCCGTCTGGTGCTACCGGTTCTCCAGGTACCCCGGGTAGCGGTACCGCATCTTCTTCTCCA |
| LCW0404_043_GFP-N_C10.ab1 | GSSPSASTGTPGSSTPSGATGSPGSSTPSGATGSP | GGTTCTAGCCCTTCTGCTTCCACCGGTACTGGCCCAGGTAGCTCTACCCCTTCTGGTGCTACCGGCTCCCCAGGTAGCTCTACTCCTTCTGGTGCAACTGGCTCTCCA |
| LCW0404_045_GFP-N_D10.ab1 | GASPGTSSTGSPGSSPSASTGTGPGSSPSASTGTGP | GGTGCTTCTCCTGGCACCAGCTCTACTGGTTCTCCAGGTTCTAGCCCTTCTGCTTCTACCGGTACTGGTCCAGGTTCTAGCCCTTCTGCATCCACTGGTACTGGTCCA |
| LCW0404_047_GFP-N_F10.ab1 | GTPGSGTASSSPGASPGTSSTGSPGASPGTSSTGSP | GGTACTCCTGGCAGCGGTACCGCTTCTTCTTCTCCAGGTGCTTCTCCTGGTACTAGCTCTACTGGTTCTCCAGGTGCTTCTCCGGGCACTAGCTCTACTGGTTCTCCA |
| LCW0404_048_GFP-N_G10.ab1 | GSSTPSGATGSPGASPGTSSTGSPGSSTPSGATGSP | GGTAGCTCTACCCCGTCTGGTGCTACCGGTTCCCCAGGTGCTTCTCCTGGTACTAGCTCTACCGGTTCTCCAGGTAGCTCTACCCCGTCTGGTGCTACTGGCTCTCCA |
| LCW0404_049_GFP-N_H10.ab1 | GSSTPSGATGSPGTPGSGTASSSPGSSTPSGATGSP | GGTAGCTCTACCCCGTCTGGTGCTACTGGTTCTCCAGGTACTCCGGGCAGCGGTACTGCTTCTTCCTCTCCAGGTAGCTCTACCCCTTCTGGTGCTACTGGCTCTCCA |
| LCW0404_050_GFP-N_A11.ab1 | GASPGTSSTGSPGSSPSASTGTGPGSSTPSGATGSP | GGTGCATCTCCTGGTACCAGCTCTACTGGTTCTCCAGGTTCTAGCCCTTCTGCTTCTACCGGTACCGGTCCAGGTAGCTCTACTCCTTCTGGTGCTACCGGTTCTCCA |
| LCW0404_051_GFP-N_B11.ab1 | GSSTPSGATGSPGSSTPSGATGSPGSSTPSGATGSP | GGTAGCTCTACCCCGTCTGGTGCTACTGGCTCTCCAGGTAGCTCTACTCCTTCTGGTGCTACTGGTTCCCCAGGTAGCTCTACCCCGTCTGGTGCAACTGGCTCTCCA |
| LCW0404_052_GFP-N_C11.ab1 | GASPGTSSTGSPGTPGSGTASSSPGASPGTSSTGSP | GGTGCATCCCCGGGTACCAGCTCTACCGGTTCTCCAGGTACTCCTGGCAGCGGTACTGCATCTTCCTCTCCAGGTGCTTCTCCGGGCACCAGCTCTACTGGTTCTCCA |
| LCW0404_053_GFP-N_D11.ab1 | GSSTPSGATGSPGSSPSASTGTGPGASPGTSSTGSP | GGTAGCTCTACTCCTTCTGGTGCAACTGGTTCTCCAGGTTCTAGCCCGTCTGCATCCACTGGTACCGGTCCAGGTGCTTCCCCTGGCACCAGCTCTACCGGTTCTCCA |
| LCW0404_057_GFP-N_E11.ab1 | GASPGTSSTGSPGSSTPSGATGSPGSSPSASTGTGP | GGTGCATCTCCTGGTACTAGCTCTACTGGTTCTCCAGGTAGCTCTACTCCGTCTGGTGCAACCGGCTCTCCAGGTTCTAGCCCTTCTGCATCTACCGGTACTGGTCCA |
| LCW0404_060_GFP-N_F11.ab1 | GTPGSGTASSSPGSSTPSGATGSPGASPGTSSTGSP | GGTACTCCTGGCAGCGGTACCGCATCTTCCTCTCCAGGTAGCTCTACTCCGTCTGGTGCAACTGGTTCCCCAGGTGCTTCTCCGGGTACCAGCTCTACCGGTTCTCCA |
| LCW0404_062_GFP-N_G11.ab1 | GSSTPSGATGSPGTPGSGTASSSPGSSTPSGATGSP | GGTAGCTCTACCCCGTCTGGTGCAACCGGCTCCCCAGGTACTCCTGGTAGCGGTACCGCTTCTTCTTCTCCAGGTAGCTCTACTCCGTCTGGTGCTACCGGCTCCCCA |
| LCW0404_066_GFP-N_H11.ab1 | GSSPSASTGTPGSSPSASTGTGPGASPGTSSTGSP | GGTTCTAGCCCTTCTGCATCCACCGGTACCGGCCCAGGTTCTAGCCCGTCTGCTTCTACCGGTACTGGTCCAGGTGCTTCTCCGGGTACTAGCTCTACTGGTTCTCCA |
| LCW0404_067_GFP-N_A12.ab1 | GTPGSGTASSSPGSSTPSGATGSPGSNPSASTGTGP | GGTACCCCGGGTAGCGGTACCGCTTCTTCTTCTCCAGGTAGCTCTACTCCGTCTGGTGCTACCGGCTCTCCAGGTTCTAACCCTTCTGCATCCACCGGTACCGGCCCA |

TABLE 16-continued

DNA and Amino Acid Sequences for AG 36-mer motifs (SEQ ID NOS 441-528, respectively, in order of appearance)

| File name | Amino acid sequence | Nucleotide sequence |
|---|---|---|
| LCW0404_068_GFP-N_B12.ab1 | GSSPSASTGTGPGSSTPS GATGSPGASPGTSSTGS P | GGTTCTAGCCCTTCTGCATCTACTGGTACTGGCCCAG GTAGCTCTACTCCTTCTGGTGCTACCGGCTCTCCAGG TGCTTCTCCGGGTACTAGCTCTACCGGTTCTCCA |
| LCW0404_069_GFP-N_C12.ab1 | GSSTPSGATGSPGASPG TSSTGSPGTPGSGTASSS P | GGTAGCTCTACCCCTTCTGGTGCAACCGGCTCTCCAG GTGCATCCCGGGTACCAGCTCTACCGGTTCTCCAG GTACTCCGGGTAGCGGTACCGCTTCTTCCTCTCCA |
| LCW0404_070_GFP-N_D12.ab1 | GSSTPSGATGSPGSSTPS GATGSPGSSTPSGATGS P | GGTAGCTCTACTCCGTCTGGTGCAACCGGTTCCCCAG GTAGCTCTACCCCTTCTGGTGCAACCGGCTCCCCAGG TAGCTCTACCCCTTCTGGTGCAACTGGCTCTCCA |
| LCW0404_073_GFP-N_E12.ab1 | GASPGTSSTGSPGTPGS GTASSSPGSSTPSGATG SP | GGTGCTTCTCCTGGCACTAGCTCTACCGGTTCTCCAG GTACCCTGGTAGCGGTACCGCATCTTCCTCTCCAGG TAGCTCTACTCCTTCTGGTGCTACTGGTTCCCCA |
| LCW0404_075_GFP-N_F12.ab1 | GSSTPSGATGSPGSSPS ASTGTGPGSSPSASTGT GP | GGTAGCTCTACCCCGTCTGGTGCTACTGGCTCCCCAG GTTCTAGCCCTTCTGCATCCACCGGTACCGGTCCAGG TTCTAGCCCGTCTGCATCTACTGGTACTGGTCCA |
| LCW0404_080_GFP-N_G12.ab1 | GASPGTSSTGSPGSSPS ASTGTGPGSSPSASTGT GP | GGTGCTTCCCCGGGCACCAGCTCTACTGGTTCTCCAG GTTCTAGCCCGTCTGCTTCTACTGGTACTGGTCCAGG TTCTAGCCCTTCTGCTTCCACTGGTACTGGTCCA |
| LCW0404_081_GFP-N_H12.ab1 | GASPGTSSTGSPGSSPS ASTGTGPGTPGSGTASS SP | GGTGCTTCCCCGGGTACCAGCTCTACCGGTTCTCCAG GTTCTAGCCCTTCTGCTTCTACCGGTACCGGTCCAGG TACCCCTGGCAGCGGTACCGCATCTTCCTCTCCA |

Example 5: Construction of XTEN_AE864

XTEN AE864 was constructed from serial dimerization of XTEN AE36 to AE72, 144, 288, 576 and 864. A collection of XTEN_AE72 segments was constructed from 37 different segments of XTEN_AE36. Cultures of E. coli harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold (DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6: Construction of XTEN_AM144

A collection of XTEN_AM144 segments was constructed starting from 37 different segments of XTEN_AE36, 44 segments of XTEN_AF36, and 44 segments of XTEN_AG36.

Cultures of E. coli that harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm. 192 isolates showed high level expression and were submitted for DNA sequencing. Most clones in library LCW0462 showed good expression and similar physico-chemical properties suggesting that most combinations of XTEN_AM36 segments yield useful XTEN sequences. Thirty isolates from LCW0462 were chosen as a preferred collection of XTEN_AM144 segments for the construction of multifunctional proteins that contain multiple XTEN segments. The file names of the nucleotide and amino acid constructs and the sequences for these segments are listed in Table 17.

TABLE 17

DNA and amino acid sequences for AM144 segments (SEQ ID NOS 529-594, respectively, in order of appearance)

| Clone | Sequence Trimmed | Protein Sequence |
|---|---|---|
| LCW462_r1 | GGTACCCCGGGCAGCGGTACCGCATCTTCCTCTCCAGGTAGC TCTACCCCGTCTGGTGCTACCGGTTCCCCAGGTAGCTCTACCC CGTCTGGTGCAACCGGCTCCCCAGGTAGCCCGGCTGGCTCTC CTACCTCTACTGAGGAAGGTACTTCTGAAAGCGCTACTCCTG AGTCTGGTCCAGGTACCTCTACTGAACCGTCCGAAGGTAGCG CTCCAGGTTCTAGCCCTTCTGCATCCACCGGTACCGGCCCAGG TTCTAGCCCGTCTGCTTCTACCGGTACTGGTCCAGGTGCTTCT CCGGGTACTAGCTCTACTGGTTCTCCAGGTACCTCTACCGAAC CGTCCGAGGGTAGCGCACCAGGTACCTCTACTGAACCGTCTG AGGGTAGCGCTCCAGGTAGCGAACCGGCAACCTCCGGTTCTG AAACTCCA | GTPGSGTASSSPGS STPSGATGSPGSSTP SGATGSPGSPAGSP TSTEEGTSESATPES GPGTSTEPSEGSAP GSSPSASTGTGPGS SPSASTGTGPGASP GTSSTGSPGTSTEPS EGSAPGTSTEPSEG SAPGSEPATSGSETP |
| LCW462_r5 | GGTTCTACCAGCGAATCCCCTTCTGGCACTGCACCAGGTTCTA CTAGCGAATCCCCTTCTGGTACCGCACCAGGTACTTCTCCGAG CGGCGAATCTTCTACTGCTCCAGGTACCTCTACTGAACCTTCC GAAGGCAGCGCTCCAGGTACCTCTACCGAACCGTCCGAGGGC AGCGCACCAGGTACTTCTGAAAGCGCAACCCCTGAATCCGGT CCAGGTGCATCTCCTGGTACCAGCTCTACCGGTTCTCCAGGTA GCTCTACTCCTTCTGGTGCTACTGGCTCTCAGGTGCTTCCC GGGTACCAGCTCTACCGGTTCTCCAGGTTCTACTAGCGAATCT CCTTCTGGCACTGCACCAGGTTCTACCAGCGAATCTCCGTCTG GCACTGCACCAGGTACCTCTACCCCTGAAAGCGGTTCCGCTT CTCCA | GSTSESPSGTAPGST SESPSGTAPGTSPSG ESSTAPGTSTEPSEG SAPGTSTEPSEGSAP GTSESATPESGPGA SPGTSSTGSPGSSTP SGATGSPGASPGTS STGSPGSTSESPSGT APGSTSESPSGTAP GTSTPESGSASP |
| LCW462_r9 | GGTACTTCTACCGAACCTTCCGAGGGCAGCGCACCAGGTACT TCTGAAAGCGCTACCCCTGAGTCCGGCCCAGGTACTTCTGAA AGCGCTACTCCTGAATCCGGTCCAGGTACCTCTACTGAACCTT CTGAGGGCAGCGCTCCAGGTACTTCTGAAAGCGCTACCCCGG AGTCCGGTCCAGGTACTTCTACTGAACCGTCCGAAGGTAGCG CACCAGGTACTTCTACTGAACCTTCCGAAGGTAGCGCTCCAG GTAGCGAACCTGCTACTTCTGGTTCTGAAACCCCAGGTAGCC CGGCTGGCTCTCCGACCTCCACCGAGGAAGGTGCTTCTCCTG GCACCAGCTCTACTGGTTCTCCAGGTTCTAGCCCTTCTGCTTC TACCGGTACTGGTCCAGGTTCTAGCCCTTCTGCATCCACTGGT ACTGGTCCA | GTSTEPSEGSAPGT SESATPESGPGTSES ATPESGPGTSTEPSE GSAPGTSESATPES GPGTSTEPSEGSAP GTSTEPSEGSAPGS EPATSGSETPGSPA GSPTSTEEGASPGT SSTGSPGSSPSASTG TGPGSSPSASTGTG P |
| LCW462_r10 | GGTAGCGAACCGGCAACCTCTGGCTCTGAAACCCCAGGTACC TCTGAAAGCGCTACTCCGGAATCTGGTCCAGGTACTTCTGAA AGCGCTACTCCGGAATCCGGTCCAGGTTCTACCAGCGAATCT CCTTCTGGCACCGCTCCAGGTTCTACTAGCGAATCCCCGTCTG GTACCGCACCAGGTACTTCTCTAGCGCGAATCTTCTACCGC ACCAGGTGCATCTCCGGGTACTAGCTCTACCGGTTCTCCAGGT TCTAGCCCTTCTGCTTCCACTGGTACCGGCCCAGGTAGCTCTA CCCCGTCTGGTGCTACTGGTTCCCCAGGTAGCTCTACTCCGTC TGGTGCAACCGGTTCCCCAGGTAGCTCTACTCCTTCTGGTGCT ACTGGCTCTCCCCAGGTGCATCCCCTGGCACCAGCTCTACCGGTT CTCCA | GSEPATSGSETPGT SESATPESGPGTSES ATPESGPGTSESPS GTAPGSTSESPSGT APGTSPSGESSTAP GASPGTSSTGSPGS SPSASTGTGPGSSTP SGATGSPGSSTPSG ATGSPGSSTPSGAT GSPGASPGTSSTGS P |
| LCW462_r15 | GGTGCTTCTCCGGGCACCAGCTCTACTGGTTCTCCAGGTTCTA GCCCTTCTGCATCCACCGGTACCGGTCCAGGTAGCTCTACCCC TTCTGGTGCAACCGGCTCTCCAGGTACTTCTGAAAGCGCTACC CCGGAATCTGGCCCAGGTAGCGAACCGGCTACTTCTGGTTCT GAAACCCCAGGTAGCGAACCGGCTACCTCCGGTTCTGAAACT CCAGGTACTTCTGAAAGCGCTACTCCGGAGTCCGGTCCAGGT ACCTCTACCGAACCGTCCGAAGGCAGCGCTCCAGGTACTTCT ACTGAACCTTCTGAGGGTAGCGCTCCAGGTACCTCTACCGAA CCGTCCGAGGGTAGCGCACCAGGTACCTCTACTGAACCGTCT GAGGGTAGCGCTCCAGGTAGCGAACCGGCAACCTCCGGTTCT GAAACTCCA | GASPGTSSTGSPGS SPSASTGTGPGSSTP SGATGSPGTSESAT PESGPGSEPATSGSE TPGSEPATSGSETP GTSESATPESGPGT STEPSEGSAPGTSTE PSEGSAPGTSTEPSE GSAPGTSTEPSEGS APGSEPATSGSETP |
| LCW462_r16 | GGTACCTCTACCGAACCTTCCGAAGGTAGCGCTCCAGGTAGC CCGGCAGGTTCTCCTACTTCCACTGAGGAAGGTACTTCTACCG AACCTTCTGAGGGTAGCGCACCAGGTACCTCTGAAAGCGCAA CTCCTGAGTCTGGCCCAGGTAGCGAACCTGCTACCTCCGGCT CTGAGACTCCAGGTACCTCTGAAAGCGCAACCCCGGAATCTG GTCCAGGTAGCCGGCTCCTCCTACCCCTCCGGCACCTCCCCAGCG GTACTTCTGAAAGCGCTACTCCTGAGTCTGGTCCAGGTACCTC TACTGAACCGTCCGAAGGTAGCGCTCCAGGTAGCGAACCTGC TACTTCTGGTTCTGAAACTCCAGGTACTTCTACCGAACCGTCC GAGGGTAGCGCTCCAGGTAGCGAACCTGCTACTTCTGGTTCT GAAACTCCA | GTSTEPSEGSAPGSP AGSPTSTEEGTSTEP SEGSAPGTSESATP ESGPGSEPATSGSE TPGTSESATPESGP GSPAGSPTSTEEGT SESATPESGPGTSTE PSEGSAPGSEPATS GSETPGTSTEPSEGS APGSEPATSGSETP |
| LCW462_r20 | GGTACTTCTACCGAACCGTCCGAAGGCAGCGCTCCAGGTACC TCTACTGAACCTTCCGAGGGCAGCGCTCCAGGTACCTCTACC GAACCTTCTGAAGGTAGCGCACCAGGTACTTCTACCGAACCG | GTSTEPSEGSAPGT STEPSEGSAPGTSTE PSEGSAPGTSTEPSE |

TABLE 17-continued

DNA and amino acid sequences for AM144 segments (SEQ ID NOS 529-594, respectively, in order of appearance)

| Clone | Sequence Trimmed | Protein Sequence |
|---|---|---|
| | TCCGAAGGCAGCGCTCCAGGTACCTCTACTGAACCTTCCGAG | GSAPGTSTEPSEGS |
| | GGCAGCGCTCCAGGTACCTCTACCGAACCTTCTGAAGGTAGC | APGTSTEPSEGSAP |
| | GCACCAGGTACTTCTACCGAACCTTCCGAGGGCAGCGCACCA | GTSTEPSEGSAPGT |
| | GGTACTTCTGAAAGCGCTACCCCTGAGTCCGGCCCAGGTACT | SESATPESGPGTSES |
| | TCTGAAAGCGCTACTCCTGAATCCGGTCCAGGTACTTCTACTG | ATPESGPGTSTEPSE |
| | AACCTTCCGAAGGTAGCGCTCCAGGTAGCGAACCTGCTACTT | GSAPGSEPATSGSE |
| | CTGGTTCTGAAACCCAGGTAGCCCGGCTGGCTCTCCGACCT | TPGSPAGSPTSTEE |
| | CCACCGAGGAA | |
| LCW462_r23 | GGTACTTCTACCGAACCGTCCGAGGGCAGCGCTCCAGGTACT | GTSTEPSEGSAPGT |
| | TCTACTGAACCTTCTGAAGGCAGCGCTCCAGGTACTTCTACTG | STEPSEGSAPGTSTE |
| | AACCTTCCGAAGGTAGCGCACCAGGTTCTACCAGCGAATCCC | PSEGSAPGSTSESPS |
| | CTTCTGGTACTGCTCCAGGTTCTACCAGCGAATCCCCTTCTGG | GTAPGSTSESPSGT |
| | CACCGCACCAGGTACTTCTACCCCTGAAAGCGGCTCCGCTTCT | APGTSTPESGSASP |
| | CCAGGTAGCGAACCTGCAACCTCTGGCTCTGAAACCCCAGGT | GSEPATSGSETPGT |
| | ACCTCTGAAAGCGCTACTCCTGAATCTGGCCCAGGTACTTCTA | SESATPESGPGTSTE |
| | CTGAACCGTCCGAGGGCAGCGCACCAGGTACTTCTACTGAAC | PSEGSAPGTSTEPSE |
| | CGTCTGAAGGTAGCGCACCAGGTACTTCTGAAAGCGCAACCC | GSAPGTSESATPES |
| | CGGAATCCGGCCCAGGTACCTCTGAAAGCGCAACCCCGGAGT | GPGTSESATPESGP |
| | CCGGCCCA | |
| LCW462_r24 | GGTAGCTCTACCCCTTCTGGTGCTACCGGCTCTCCAGGTTCTA | GSSTPSGATGSPGS |
| | GCCCGTCTGCTTCTACCGGTACCGGTCCAGGTAGCTCTACCCC | SPSASTGTGPGSSTP |
| | TTCTGGTGCTACTGGTTCTCCAGGTAGCCCTGCTGGCTCTCCG | SGATGSPGSPAGSP |
| | ACTTCTACTGAGGAAGGTAGCCCGGCTGGTTCTCCGACTTCTA | TSTEEGSPAGSPTST |
| | CTGAGGAAGGTACTTCTACCGAACCTTCCGAAGGTAGCGCTC | EEGTSTEPSEGSAP |
| | CAGGTGCTTCCCCGGGCACTAGCTCTACCGGTTCTCCAGGTTC | GASPGTSSTGSPGS |
| | TAGCCCTTCTGCATCTACTGGTACTGGCCCAGGTACTCCGGGC | SPSASTGTGPGTPG |
| | AGCGGTACTGCTTCTTCCTCTCCAGGTTCTACTAGCTCTACTG | SGTASSSPGSTSSTA |
| | CTGAATCCTCTGGCCCAGGTACTTCTCCTAGCGGTGAATCTTC | ESPGPGTSPSGESST |
| | TACCGCTCCAGGTACCTCTACTCCGGAAAGCGGTTCTGCATCT | APGTSTPESGSASP |
| | CCA | |
| LCW462_r27 | GGTACCTCTACTGAACCTTCTGAGGGCAGCGCTCCAGGTACT | GTSTEPSEGSAPGT |
| | TCTGAAAGCGCTACCCCGGAGTCCGGTCCAGGTACTTCTACT | SESATPESGPGTSTE |
| | GAACCGTCCGAAGGTAGCGCACCAGGTACTTCTACTGAACCG | PSEGSAPGTSTEPSE |
| | TCTGAAGGTAGCGCACCAGGTACTTCTGAAAGCGCAACCCCG | GSAPGTSESATPES |
| | GAATCCGGCCCAGGTACCTCTGAAAGCGCAACCCCGGAGTCC | GPGTSESATPESGP |
| | GGCCCAGGTACTCCTGGCAGCGGTACCGCTTCTTCTTCTCCAG | GTPGSGTASSSPGA |
| | GTGCTTCTCCTGGTACTAGCTCTACTGGTTCTCCAGGTGCTTC | SPGTSSTGSPGASP |
| | TCCGGGCACTAGCTCTACTGGTTCTCCAGGTAGCCCTGCTGGC | GTSSTGSPGSPAGS |
| | TCTCCGACTTCTACTGAGGAAGGTAGCCCGGCTGGTTCTCCG | PTSTEEGSPAGSPTS |
| | ACTTCTACTGAGGAAGGTACTTCTACCGAACCTTCCGAAGGT | TEEGTSTEPSEGSAP |
| | AGCGCTCCA | |
| LCW462_r28 | GGTAGCCCAGCAGGCTCTCCGACTTCCACTGAGGAAGGTACT | GSPAGSPTSTEEGT |
| | TCTACTGAACCTTCCGAAGGCAGCGCACCAGGTACCTCTACT | STEPSEGSAPGTSTE |
| | GAACCTTCTGAGGGCAGCGCTCCAGGTACCTCTACCGAACCG | PSEGSAPGTSTEPSE |
| | TCTGAAGGTAGCGCACCAGGTACCTCTGAAAGCGCAACTCCT | GSAPGTSESATPES |
| | GAGTCCGGTCCAGGTACTTCTGAAAGCGCAACCCCGGAGTCT | GPGTSESATPESGP |
| | GGCCCAGGTACCCCGGGTAGCGGTACTGCTTCTTCCTCTCCAG | GTPGSGTASSSPGS |
| | GTAGCTCTACCCCTTCTGGTGCAACCGGCTCTCCAGGTGCTTC | STPSGATGSPGASP |
| | TCCGGGCACCAGCTCTACCGGTTCTCCAGGTACCTCTACTGAA | GTSSTGSPGTSTEPS |
| | CCTTCTGAGGGCAGCGCTCCAGGTACTTCTGAAAGCGCTACC | EGSAPGTSESATPE |
| | CCGGAGTCCGGTCCAGGTACTTCTACTGAACCGTCCGAAGGT | SGPGTSTEPSEGSAP |
| | AGCGCACCA | |
| LCW462_r38 | GGTAGCGAACCGGCAACCTCCGGCTCTGAAACTCCAGGTACT | GSEPATSGSETPGT |
| | TCTGAAAGCGCTACTCCGGAATCCGGCCCAGGTAGCGAACCG | SESATPESGPGSEPA |
| | GCTACTTCCGGCTCTGAAACCCCAGGTAGCTCTACCCCCGTCTG | TSGSETPGSSTPSGA |
| | GTGCAACCGGCTCCCAGGTACTCCTGGTAGCGGTACCGCTT | TGSPGTPGSGTASS |
| | CTTCTTCTCCAGGTAGCTCTACTCCGTCTGGTGCTACCGGCTC | SPGSSTPSGATGSP |
| | CCCAGGTGCATCTCCTGGTACCAGCTCTACCGGTTCTCCAGGT | GASPGTSSTGSPGS |
| | AGCTCTACTCCTTCTGGTGCTACTGGCTCTCCAGGTGCTTCCC | STPSGATGSPGASP |
| | CGGGTACCAGCTCTACCGGTTCTCCAGGTAGCGAACCTGCTA | GTSSTGSPGSEPATS |
| | CTTCTGGTTCTGAAACTCCAGGTACTTCTACCGAACCGTCCGA | GSETPGTSTEPSEGS |
| | GGGTAGCGCTCCAGGTAGCGAACCTGCTACTTCGGTTCTGA | APGSEPATSGSETP |
| | AACTCCA | |
| LCW462_r39 | GGTACCTCTACTGAACCTTCCGAAGGCAGCGCTCCAGGTACC | GTSTEPSEGSAPGT |
| | TCTACCGAACCGTCCGAGGGCAGCGCACCAGGTACTTCTGAA | STEPSEGSAPGTSES |
| | AGCGCAACCCCTGAATCCGGTCCAGGTAGCCCTGCTGGCTCT | ATPESGPGSPAGSP |
| | CCGACTTCTACTGAGGAAGGTAGCCCGGCTGGTTCTCCGACT | TSTEEGSPAGSPTST |
| | TCTACTGAGGAAGGTACTTCTACCGAACCTTCCGAAGGTAGC | EEGTSTEPSEGSAP |
| | GCTCCAGGTAGCCCGGCTGGTTCTCCGACTTCCACCGAGGAA | GSPAGSPTSTEEGT |

TABLE 17-continued

DNA and amino acid sequences for AM144 segments (SEQ ID NOS 529-594, respectively, in order of appearance)

| Clone | Sequence Trimmed | Protein Sequence |
|---|---|---|
| | GGTACCTCTACTGAACCTTCTGAGGGTAGCGCTCCAGGTACC<br>TCTACTGAACCTTCCGAAGGCAGCGCTCCAGGTGCTTCCCCG<br>GGCACCAGCTCTACTGGTTCTCCAGGTTCTAGCCCGTCTGCTT<br>CTACTGGTACTGGTCCAGGTTCTAGCCCTTCTGCTTCCACTGG<br>TACTGGTCCA | STEPSEGSAPGTSTE<br>PSEGSAPGASPGTS<br>STGSPGSSPSASTGT<br>GPGSSPSASTGTGP |
| LCW462_r41 | GGTAGCTCTACCCCGTCTGGTGCTACCGGTTCCCCAGGTGCTT<br>CTCCTGGTACTAGCTCTACCGGTTCTCCAGGTAGCTCTACCCC<br>GTCTGGTGCTACTGGCTCTCCAGGTAGCCCTGCTGGCTCTCCA<br>ACCTCCACCGAAGAAGGTACCTCTGAAAGCGCAACCCCTGAA<br>TCCGGCCCAGGTAGCGAACCGGCAACCTCCGGTTCTGAAACC<br>CCAGGTGCATCTCCTGGTACTAGCTCTACTGGTTCTCCAGGTA<br>GCTCTACTCCGTCTGGTGCAACCGGCTCTCCAGGTTCTAGCCC<br>TTCTGCATCTACCGGTACTGGTCCAGGTTCTACCAGCGAATCC<br>CCTTCTGGTACTGCTCCAGGTTCTACCAGCGAATCCCCTTCTG<br>GCACCGCACCAGGTACTTCTACCCCTGAAAGCGGCTCCGCTT<br>CTCCA | GSSTPSGATGSPGA<br>SPGTSSTGSPGSSTP<br>SGATGSPGSPAGSP<br>TSTEEGTSESATPES<br>GPGSEPATSGSETP<br>GASPGTSSTGSPGS<br>STPSGATGSPGSSPS<br>ASTGTGPGSTSESPS<br>GTAPGSTSESPSGT<br>APGTSTPESGSASP |
| LCW462_r42 | GGTTCTACCAGCGAATCTCCTTCTGGCACCGCTCCAGGTTCTA<br>CTAGCGAATCCCCGTCTGGTACCGCACCAGGTACTTCTCCTAG<br>CGGCGAATCTTCTACCGCACCAGGTACCTCTGAAAGCGCTAC<br>TCCGGAGTCTGGCCCAGGTACCTCTACTGAACCGTCTGAGGG<br>TAGCGCTCCAGGTACTTCTACTGAACCGTCCGAAGGTAGCGC<br>ACCAGGTACCTCTACTGAACCTTCTGAGGGCAGCGCTCCAGG<br>TACTTCTGAAAGCGCTACCCCGGAGTCCGGTCCAGGTACTTCT<br>ACTGAACCGTCCGAAGGTAGCGCACCAGGTAGCTCTACCCCG<br>TCTGGTGCTACCGGTTCCCCAGGTGCTTCTCCTGGTACTAGCT<br>CTACCGGTTCTCCAGGTAGCTCTACCCCGTCTGGTGCTACTGG<br>CTCTCCA | GSTSESPSGTAPGST<br>SESPSGTAPGTSPSG<br>ESSTAPGTSESATPE<br>SGPGTSTEPSEGSAP<br>GTSTEPSEGSAPGT<br>STEPSEGSAPGTSES<br>ATPESGPGTSTEPSE<br>GSAPGSSTPSGATG<br>SPGASPGTSSTGSP<br>GSSTPSGATGSP |
| LCW462_r43 | GGTTCTACTAGCTCTACTGCAGAATCTCCGGGCCCAGGTACCT<br>CTCCTAGCGGTGAATTTCTACCGCTCCAGGTACTTCTCCGAG<br>CGGTGAATCTTCTACCGCTCCAGGTTCTACTAGCTCTACCGCT<br>GAATCTCCGGGTCCAGGTTCTACCAGCTCTACTGCAGAATCTC<br>CTGGCCCAGGTACTTCTACTCCGGAAAGCGGTTCCGCTTCTCC<br>AGGTACTTCTCCTAGCGGTGAATCTTCTACCGCTCCAGGTTCT<br>ACCAGCTCTACTGCTGAATCTCCTGGCCCAGGTACTTCTACCC<br>CGGAAAGCGGCTCCGCTTCTCCAGGTTCTACCAGCTCTACCG<br>CTGAATCTCCTGGCCCAGGTTCTACTAGCGAATCTCCGTCTGG<br>CACCGCACCAGGTACTTCCCCTAGCGGTGAATCTTCTACTGCA<br>CCA | GSTSSTAESPGPGTS<br>PSGESSTAPGTSPSG<br>ESSTAPGSTSSTAES<br>PGPGSTSSTAESPGP<br>GTSTPESGSASPGTS<br>PSGESSTAPGSTSST<br>AESPGPGTSTPESGS<br>ASPGSTSSTAESPGP<br>GSTSESPSGTAPGTS<br>PSGESSTAP |
| LCW462_r45 | GGTACCTCTACTCCGGAAAGCGGTTCCGCATCTCCAGGTTCTA<br>CCAGCGAATCCCCGTCTGGCACCGCACCAGGTTCTACTAGCT<br>CTACTGCTGAATCTCCGGGCCCAGGTACCTCTACTGAACCTTC<br>CGAAGGCAGCGCTCCAGGTACCTCTACCGAACCGTCCGAGGG<br>CAGCGCACCAGGTACTTCTGAAAGCGCAACCCCTGAATCCGG<br>TCCAGGTACCTCTGAAAGCGCTACTCCGGAGTCTGGCCCAGG<br>TACCTCTACTGAACCGTCTGAGGGTAGCGCTCCAGGTACTTCT<br>ACTGAACCGTCCGAAGGTAGCGCACCAGGTACTTCTGAAAGC<br>GCTACTCCGGAGTCCGGTCCAGGTACCTCTACCGAACCGTCC<br>GAAGGCAGCGCTCCAGGTACTTCTACTGAACCTTCTGAGGGT<br>AGCGCTCCC | GTSTPESGSASPGST<br>SESPSGTAPGSTSST<br>AESPGPGTSTEPSE<br>GSAPGTSTEPSEGS<br>APGTSESATPESGP<br>GTSESATPESGPGT<br>STEPSEGSAPGTSTE<br>PSEGSAPGTSESATP<br>ESGPGTSTEPSEGS<br>APGTSTEPSEGSAP |
| LCW462_r47 | GGTACCTCTACCGAACCGTCCGAGGGTAGCGCACCAGGTACC<br>TCTACTGAACCGTCTGAGGGTAGCGCTCCAGGTAGCGAACCG<br>GCAACCTCCGGTTCTGAAACTCCAGGTACTTCTACTGAACCGT<br>CTGAAGGTAGCGCACCAGGTACTTCTGAAAGCGCAACCCCGG<br>AATCCGGCCCAGGTACCTCTGAAAGCGCAACCCCGGAGTCCG<br>GCCCAGGTGCATCTCCGGGTACTAGCTCTACCGGTTCTCCAG<br>GTTCTAGCCCTTCTGCTTCCACTGGTACCGGCCAGGTAGCTC<br>TACCCCGTCTGGTGCTACTGGTTCCCCAGGTAGCTCTACTCCG<br>TCTGGTGCAACCGGTTCCCCAGGTAGCTCTACTCCTTCTGGTG<br>CTACTGGCTCCCCAGGTGCATCCCCTGGCACCAGCTCTACCG<br>GTTCTCCA | GTSTEPSEGSAPGT<br>STEPSEGSAPGSEPA<br>TSGSETPGTSTEPSE<br>GSAPGTSESATPES<br>GPGTSESATPESGP<br>GASPGTSSTGSPGS<br>SPSASTGTGPGSSTP<br>SGATGSPGSSTPSG<br>ATGSPGSSTPSGAT<br>GSPGASPGTSSTGS<br>P |
| LCW462_r54 | GGTAGCGAACCGGCAACCTCTGGCTCTGAAACTCCAGGTAGC<br>GAACCTGCAACCTCCGGCTCTGAAACCCCAGGTACTTCTACT<br>GAACCTTCTGAGGGCAGCGCACCAGGTAGCGAACCTGCAACC<br>TCTGGCTCTGAAACCCCAGGTACCTCTGAAAGCGCTACTCCT<br>GAATCTGGCCCAGGTACTTCTACTGAACCGTCCGAGGGCAGC<br>GCACCAGGTAGCTCTACTCCGTCTGGTGCTACCGGCTCTCCAG<br>GTAGCTCTACCCCTTCTGGTGCAACCGGCTCTCCCAGGTGCTTC | GSEPATSGSETPGS<br>EPATSGSETPGTSTE<br>PSEGSAPGSEPATS<br>GSETPGTSESATPES<br>GPGTSTEPSEGSAP<br>GSSTPSGATGSPGS<br>STPSGATGSPGASP |

TABLE 17-continued

DNA and amino acid sequences for AM144 segments (SEO ID NOS 529-594, respectively, in order of appearance)

| Clone | Sequence Trimmed | Protein Sequence |
|---|---|---|
| | TCCGGGTACCAGCTCTACTGGTTCTCCAGGTAGCTCTACCCCG TCTGGTGCTACCGGTTCCCCAGGTGCTTCTCCTGGTACTAGCT CTACCGGTTCTCCAGGTAGCTCTACCCCGTCTGGTGCTACTGG CTCTCCA | GTSSTGSPGSSTPSG ATGSPGASPGTSST GSPGSSTPSGATGS P |
| LCW462_r55 | GGTACTTCTACCGAACCGTCCGAGGGCAGCGCTCCAGGTACT TCTACTGAACCTTCTGAAGGCAGCGCTCCAGGTACTTCTACTG AACCTTCCGAAGGTAGCGCACCAGGTACTTCTGAAAGCGCTA CTCCGGAGTCCGGTCCAGGTACCTCTACCGAACCGTCCGAAG GCAGCGCTCCAGGTACTTCTACTGAACCTTCTGAGGGTAGCG CTCCAGGTTCTACTAGCGAATCTCCGTCTGGCACTGCTCCAGG TACTTCTCCTAGCGGTGAATCTTCTACCGCTCCAGGTACTTCC CCTAGCGGCGAATCTTCTACCGCTCCAGGTAGCCCGGCTGGC TCTCCTACCTCTACTGAGGAAGGTACTTCTGAAAGCGCTACTC CTGAGTCTGGTCCAGGTACCTCTACTGAACCGTCCGAAGGTA GCGCTCCA | GTSTEPSEGSAPGT STEPSEGSAPGTSTE PSEGSAPGTSESATP ESGPGTSTEPSEGS APGTSTEPSEGSAP GSTSESPSGTAPGTS PSGESSTAPGTSPSG ESSTAPGSPAGSPTS TEEGTSESATPESGP GTSTEPSEGSAP |
| LCW462_r57 | GGTACTTCTACTGAACCTTCCGAAGGTAGCGCTCCAGGTAGC GAACCTGCTACTTCTGGTTCTGAAACCCCAGGTAGCCCGGCT GGCTCTCCGACCTCCACCGAGGAAGGTAGCCCGGCAGGCTCT CCGACCTCTACTGAGGAAGGTACTTCTGAAAGCGCAACCCCG GAGTCCGGCCCAGGTACCTCTACCGAACCGTCTGAGGGCAGC GCACCAGGTACCTCTACTGAACCTTCCGAAGGCAGCGCTCCA GGTACCTCTACCGAACCGTCCGAGGGCAGCGCTCCAGGTACT TCTGAAAGCGCAACCCCTGAATCCGGTCCAGGTAGCTCTACT CCGTCTGGTGCAACCGGCTCCCCAGGTTCTAGCCCGTCTGCTT CCACTGGTACTGGCCCAGGTGCTTCCCCGGGCACCAGCTCTA CTGGTTCTCCA | GTSTEPSEGSAPGS EPATSGSETPGSPA GSPTSTEEGSPAGSP TSTEEGTSESATPES GPGTSTEPSEGSAP GTSTEPSEGSAPGT STEPSEGSAPGTSES ATPESGPGSSTPSG ATGSPGSSPSASTG TGPGASPGTSSTGS P |
| LCW462_r61 | GGTAGCGAACCGGCTACTTCCGGCTCTGAGACTCCAGGTAGC CCTGCTGGCTCTCCGACCTCTACCGAAGAAGGTACCTCTGAA AGCGCTACCCCTGAGTCTGGCCCAGGTACCTCTACTGAACCTT CCGAAGGCAGCGCTCCAGGTACCTCTACCGAACCGTCCGAGG GCAGCGCACCAGGTACTTCTGAAAGCGCAACCCCTGAATCCG GTCCAGGTACCTCTACTCCGGAAAGCGGTTCCGCATCTCCAG GTTCTACCAGCGAATCCCCGTCTGGCACCGCACCAGGTTCTA CTAGCTCTACTGCTGAATCTCCGGGCCAGGTACTTCTGAAA GCGCTACTCCGGAGTCCGGTCCAGGTACCTCTACCGAACCGT CCGAAGGCAGCGCTCCAGGTACTTCTACTGAACCTTCTGAGG GTAGCGCTCCA | GSEPATSGSETPGSP AGSPTSTEEGTSES ATPESGPGTSTEPSE GSAPGTSTEPSEGS APGTSESATPESGP GTSTPESGSASPGST SESPSGTAPGSTSST AESPGPGTSESATP ESGPGTSTEPSEGS APGTSTEPSEGSAP |
| LCW462_r64 | GGTACTTCTACCGAACCGTCCGAGGGCAGCGCTCCAGGTACT TCTACTGAACCTTCTGAAGGCAGCGCTCCAGGTACTTCTACTG AACCTTCCGAAGGTAGCGCACCAGGTACCTCTACCGAACCGT CTGAAGGTAGCGCACCAGGTACCTCTGAAAGCGCAACTCCTG AGTCCGGTCCAGGTACTTCTGAAAGCGCAACCCCGGAGTCTG GCCCAGGTACTCCTGGCAGCGGTACCGCATCTTCCTCTCCAG GTAGCTCTACTCCGTCTGGTGCAACTGGTTCCCCAGGTGCTTC TCCGGGTACCAGCTCTACCGGTTCTCCAGGTTCCACCAGCTCT ACTGCTGAATCTCCTGGTCCAGGTACCTCTCCTAGCGGTAAT CTTCTACTGCTCCAGGTACTTCTACTCCTGAAAGCGGCTCTGC TTCTCCA | GTSTEPSEGSAPGT STEPSEGSAPGTSTE PSEGSAPGTSTEPSE GSAPGTSESATPES GPGTSESATPESGP GTPGSGTASSSPGS STPSGATGSPGASP GTSSTGSPGSTSSTA ESPGPGTSPSGESST APGTSTPESGSASP |
| LCW462_r67 | GGTAGCCCGGCAGGCTCTCCGACCTCTACTGAGGAAGGTACT TCTGAAAGCGCAACCCCGGAGTCCGGCCCAGGTACCTCTACC GAACCGTCTGAGGGCAGCGCACCAGGTACTTCTGAAAGCGCA ACCCCTGAATCCGGTCCAGGTAGCGAACCGGCTACTTCTGGC TCTGAGACTCCAGGTACTTCTACCGAACCGTCCGAAGGTAGC GCACCAGGTAGCCCGGCTGGTTCTCCGACTTCCACCGAGGAA GGTACCTCTACTGAACCTTCTGAGGGTAGCGCTCCAGGTACC TCTACTGAACCTTCCGAAGGCAGCGCTCCAGGTACTTCTACC GAACCGTCCGAGGGCAGCGCTCCAGGTACTTCTACTGAACCT TCTGAAGGCAGCGCTCCAGGTACTTCTACTGAACCTTCCGAA GGTAGCGCACCA | GSPAGSPTSTEEGT SESATPESGPGTSTE PSEGSAPGTSESATP ESGPGSEPATSGSE TPGTSTEPSEGSAP GSPAGSPTSTEEGT STEPSEGSAPGTSTE PSEGSAPGTSTEPSE GSAPGTSTEPSEGS APGTSTEPSEGSAP |
| LCW462_r69 | GGTACTTCTCCGAGCGGTGAATCTTCTACCGCACCAGGTTCTA CTAGCTCTACCGCTGAATCTCCGGGCCCAGGTACTTCTCCGAG CGGTGAATCTTCTACTGCTCCAGGTACCTCTGAAAGCGCTACT CCGGAGTCTGGCCCAGGTACCTCTACTGAACCGTCTGAGGGT AGCGCTCCAGGTACTTCTACTGAACCGTCCGAAGGTAGCGCA CCAGGTTCTAGCCCTTCTGCATCTACTGGTACTGGCCCAGGTA | GTSPSGESSTAPGST SSTAESPGPGTSPSG ESSTAPGTSESATPE SGPGTSTEPSEGSAP GTSTEPSEGSAPGSS PSASTGTGPGSSTPS |

TABLE 17-continued

DNA and amino acid sequences for AM144 segments (SEQ ID NOS 529-594, respectively, in order of appearance)

| Clone | Sequence Trimmed | Protein Sequence |
|---|---|---|
|  | GCTCTACTCCTTCTGGTGCTACCGGCTCTCCAGGTGCTTCTCC<br>GGGTACTAGCTCTACCGGTTCTCCAGGTACTTCTACTCCGGAA<br>AGCGGTTCCGCATCTCCAGGTACTTCTCCTAGCGGTGAATCTT<br>CTACTGCTCCAGGTACCTCTCCTAGCGGCGAATCTTCTACTGC<br>TCCA | GATGSPGASPGTSS<br>TGSPGTSTPESGSAS<br>PGTSPSGESSTAPGT<br>SPSGESSTAP |
| LCW462_r70 | GGTACCTCTGAAAGCGCTACTCCGGAGTCTGGCCCAGGTACC<br>TCTACTGAACCGTCTGAGGGTAGCGCTCCAGGTACTTCTACTG<br>AACCGTCCGAAGGTAGCGCACCAGGTAGCCCTGCTGGCTCTC<br>CGACTTCTACTGAGGAAGGTAGCCCGGCTGGTTCTCCGACTT<br>CTACTGAGGAAGGTACTTCTACCGAACCTTCCGAAGGTAGCG<br>CTCCAGGTTCTAGCCCTTCTGCTTCCACCGGTACTGGCCCAGG<br>TAGCTCTACCCCTTCTGGTGCTACCGGCTCTCCAGGTAGCTCT<br>ACTCCTTCTGGTGCAACTGGCTCTCCAGGTAGCGAACCGGCA<br>ACTTCCGGCTCTGAAACCCCAGGTACTTCTGAAAGCGCTACT<br>CCTGAGTCTGGCCCAGGTAGCGAACCTGCTACCTCTGGCTCT<br>GAAACCCCA | GTSESATPESGPGT<br>STEPSEGSAPGTSTE<br>PSEGSAPGSPAGSP<br>TSTEEGSPAGSPTST<br>EEGTSTEPSEGSAP<br>GSSPSASTGTGPGS<br>STPSGATGSPGSSTP<br>SGATGSPGSEPATS<br>GSETPGTSESATPES<br>GPGSEPATSGSETP |
| LCW462_r72 | GGTACTTCTACCGAACCGTCCGAAGGCAGCGCTCCAGGTACC<br>TCTACTGAACCTTCCGAGGGCAGCGCTCCAGGTACCTCTACC<br>GAACCTTCTGAAGGTAGCGCACCAGGTAGCTCTACCCCGTCT<br>GGTGCTACCGGTTCCCCAGGTGCTTCTCCTGGTACTAGCTCTA<br>CCGGTTCTCCAGGTAGCTCTACCCCGTCTGGTGCTACTGGCTC<br>TCCAGGTACTTCTGAAAGCGCAACCCCTGAATCCGGTCCAGG<br>TAGCGAACCGGCTACTTCTGGCTCTGAGACTCCAGGTACTTCT<br>ACCGAACCGTCCGAAGGTAGCGCACCAGGTTCTACTAGCGAA<br>TCTCCTTCTGGCACTGCACCAGGTTCTACCAGCGAATCTCCGT<br>CTGGCACTGCACCAGGTACCTCTACCCCTGAAAGCGGTTCCG<br>CTTCTCCA | GTSTEPSEGSAPGT<br>STEPSEGSAPGTSTE<br>PSEGSAPGSSTPSG<br>ATGSPGASPGTSST<br>GSPGSSTPSGATGS<br>PGTSESATPESGPGS<br>EPATSGSETPGTSTE<br>PSEGSAPGSTSESPS<br>GTAPGSTSESPSGT<br>APGTSTPESGSASP |
| LCW462_r73 | GGTACCTCTACTCCTGAAAGCGGTTCTGCATCTCCAGGTTCCA<br>CTAGCTCTACCGCAGAATCTCCGGGCCCAGGTTCTACTAGCTC<br>TACTGCTGAATCTCCTGGCCCAGGTTCTAGCCCTTCTGCATCT<br>ACTGGTACTGGCCCAGGTAGCTCTACTCCTTCTGGTGCTACCG<br>GCTCTCCAGGTGCTTCTCCGGGTACTAGCTCTACCGGTTCTCC<br>AGGTAGCGAACCGGCAACCTCCGGCTCTGAAACCCCAGGTAC<br>CTCTGAAAGCGCTACTCCTGAATCGGCCCAGGTAGCCCGGC<br>AGGTTCTCCGACTTCCACTGAGGAAGGTTCTACTAGCGAATC<br>TCCTTCTGGCACTGCACCAGGTTCTACCAGCGAATCTCCGTCT<br>GGCACTGCACCAGGTACCTCTACCCCTGAAAGCGGTTCCGCT<br>TCTCCC | GTSTPESGSASPGST<br>SSTAESPGPGSTSST<br>AESPGPGSSPSAST<br>GTGPGSSTPSGATG<br>SPGASPGTSSTGSP<br>GSEPATSGSETPGT<br>SESATPESGPGSPA<br>GSPTSTEEGSTSESP<br>SGTAPGSTSESPSGT<br>APGTSTPESGSASP |
| LCW462_r78 | GGTAGCCCGGCTGGCTCTCCTACCTCTACTGAGGAAGGTACT<br>TCTGAAAGCGCTACTCCTGAGTCTGGTCCAGGTACCTCTACTG<br>AACCGTCCGAAGGTAGCGCTCCAGGTTCTACCAGCGAATCTC<br>CTTCTGGCACCGCTCCAGGTTCTACTAGCGAATCCCCGTCTGG<br>TACCGCACCAGGTACTTCTCCTAGCGGCGAATCTTCTACCGCA<br>CCAGGTACCTCTACCGAACCTTCCGAAGGTAGCGCTCCAGGT<br>AGCCCGGCAGGTTCTCCTACTTCCACTGAGGAAGGTACTTCT<br>ACCGAACCTTCTGAGGGTAGCGCACCAGGTAGCGAACCTGCA<br>ACCTCTGGCTCTGAAACCCCAGGTACCTCTGAAAGCGCTACT<br>CCTGAATCTGGCCCAGGTACTTCTACTGAACCGTCCGAGGGC<br>AGCGCACCA | GSPAGSPTSTEEGT<br>SESATPESGPGTSTE<br>PSEGSAPGSTSESPS<br>GTAPGSTSESPSGT<br>APGTSPSGESSTAP<br>GTSTEPSEGSAPGSP<br>AGSPTSTEEGTSTEP<br>SEGSAPGSEPATSG<br>SETPGTSESATPESG<br>PGTSTEPSEGSAP |
| LCW462_r79 | GGTACCTCTACCGAACCTTCCGAAGGTAGCGCTCCAGGTAGC<br>CCGGCAGGTTCTCCTACTTCCACTGAGGAAGGTACTTCTACCG<br>AACCTTCTGAGGGTAGCGCACCAGGTACCTCCCCTAGCGGCG<br>AATCTTCTACTGCTCCAGGTACCTCTCCTAGCGGCGAATCTTC<br>TACCGCTCCAGGTACCTCCCTAGCGGTGAATCTTCTACCGCA<br>CCAGGTTCTACCAGCGAATCCCCTTCTGGTACTGCTCCAGGTT<br>CTACCAGCGAATCCCCTTCTGGCACCGCACCAGGTACTTCTAC<br>CCCTGAAAGCGGCTCCGCTTCTCCAGGTAGCGAACCTGCAAC<br>CTCTGGCTCTGAAACCCCAGGTACCTCTGAAAGCGCTACTCCT<br>GAATCTGGCCCAGGTACTTCTACTGAACCGTCCGAGGGCAGC<br>GCACCA | GTSTEPSEGSAPGSP<br>AGSPTSTEEGTSTEP<br>SEGSAPGTSPSGESS<br>TAPGTSPSGESSTAP<br>GTSPSGESSTAPGST<br>SESPSGTAPGSTSES<br>PSGTAPGTSTPESGS<br>ASPGSEPATSGSETP<br>GTSESATPESGPGT<br>STEPSEGSAP |
| LCW462_r87 | GGTAGCGAACCGGCAACCTCTGGCTCTGAAACCCCAGGTACC<br>TCTGAAAGCGCTACTCCGGAATCTGGTCCAGGTACTTCTGAA<br>AGCGCTACTCCGGAATCCGGTCAGGTACTTCTCCGAGCGGT<br>GAATCTTCTACCGCACCAGGTTCTACTAGCTCTACCGCTGAAT<br>CTCCGGGCCCAGGTACTTCTCCGAGCGGTGAATCTTCTACTGC<br>TCCAGGTTCTACTAGCGAATCCCGTCTGGTACTGCTCCAGGT<br>ACTTCCCCTAGCGGTGAATCTTCTACTGCTCCAGGTTCTACCA | GSEPATSGSETPGT<br>SESATPESGPGTSES<br>ATPESGPGTSPSGES<br>STAPGSTSSTAESPG<br>PGTSPSGESSTAPGS<br>TSESPSGTAPGTSPS<br>GESSTAPGSTSSTA |

TABLE 17-continued

DNA and amino acid sequences for AM144 segments (SEQ ID NOS 529-594, respectively, in order of appearance)

| Clone | Sequence Trimmed | Protein Sequence |
|---|---|---|
|  | GCTCTACCGCAGAATCTCCGGGTCCAGGTAGCTCTACTCCGTC | ESPGPGSSTPSGAT |
|  | TGGTGCAACCGGTTCCCCAGGTAGCTCTACCCCTTCTGGTGCA | GSPGSSTPSGATGS |
|  | ACCGGCTCCCCAGGTAGCTCTACCCCTTCTGGTGCAAACTGG | PGSSTPSGANWLS |
|  | CTCTCC |  |
| LCW462_r88 | GGTAGCCCTGCTGGCTCTCCGACTTCTACTGAGGAAGGTAGC | GSPAGSPTSTEEGSP |
|  | CCGGCTGGTTCTCCGACTTCTACTGAGGAAGGTACTTCTACCG | AGSPTSTEEGTSTEP |
|  | AACCTTCCGAAGGTAGCGCTCCAGGTACCTCTACTGAACCTT | SEGSAPGTSTEPSE |
|  | CCGAAGGCAGCGCTCCAGGTACCTCTACCGAACCGTCCGAGG | GSAPGTSTEPSEGS |
|  | GCAGCGCACCAGGTACTTCTGAAAGCGCAACCCCTGAATCCG | APGTSESATPESGP |
|  | GTCCAGGTGCATCTCCTGGTACCAGCTCTACCGGTTCTCCAGG | GASPGTSSTGSPGS |
|  | TAGCTCTACTCCTTCTGGTGCTACTGGCTCTCCAGGTGCTTCC | STPSGATGSPGASP |
|  | CCGGGTACCAGCTCTACCGGTTCTCCAGGTAGCTCTACCCCGT | GTSSTGSPGSSTPSG |
|  | CTGGTGCTACTGGTTCTCCAGGTACTCCGGGCAGCGGTACTG | ATGSPGTPGSGTAS |
|  | CTTCTTCCTCTCCAGGTAGCTCTACCCCTTCTGGTGCTACTGG | SSPGSSTPSGATGSP |
|  | CTCTCCA |  |
| LCW462_r89 | GGTAGCTCTACCCCGTCTGGTGCTACTGGTTCTCCAGGTACTC | GSSTPSGATGSPGT |
|  | CGGGCAGCGGTACTGCTTCTTCCTCTCCAGGTAGCTCTACCCC | PGSGTASSSPGSSTP |
|  | TTCTGGTGCTACTGGCTCTCCAGGTAGCCCGGCTGGCTCTCCT | SGATGSPGSPAGSP |
|  | ACCTCTACTGAGGAAGGTACTTCTGAAAGCGCTACTCCTGAG | TSTEEGTSESATPES |
|  | TCTGGTCCAGGTACCTCTACTGAACCGTCCGAAGGTAGCGCT | GPGTSTEPSEGSAP |
|  | CCAGGTACCTCTGAAAGCGCAACTCCTGAGTCTGGCCCAGGT | GTSESATPESGPGS |
|  | AGCGAACCTGCTACCTCCGGCTCTGAGACTCCAGGTACCTCT | EPATSGSETPGTSES |
|  | GAAAGCGCAACCCCGGAATCTGGTCCAGGTACTTCTACTGAA | ATPESGPGTSTEPSE |
|  | CCGTCTGAAGGTAGCGCACCAGGTACTTCTGAAAGCGCAACC | GSAPGTSESATPES |
|  | CCGGAATCCGGCCCAGGTACCTCTGAAAGCGCAACCCCGGAG | GPGTSESATPESGP |
|  | TCCGGCCCA |  |

Example 7: Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8: Construction of XTEN_AM432

We generated a library of XTEN_AM432 segments by recombining segments from library LCW0462 of XTEN_AM144 segments and segments from library LCW0463 of XTENAM288 segments. This new library of XTEN_AM432 segment was designated LCW0464. Plasmids were isolated from cultures of E. coli harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTENAM432 segments using preferred segments of XTEN_AM144 and XTEN_AM288. Screening this library yielded 4 isolates that were selected for further construction Example 9: Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIfor P: AGGTGCAAGCGCAAGCGGCGCGC-CAAGCACGGGAGGTTCGTCTTCACTCGAGGGTAC (SEQ ID NO: 1652) and the non-phosphorylated oligonucleotide BsaI-AscI-KpnIrev: CCTCGAGTGAAGACGAAC-CTCCCGTGCTTGGCGCGCCGCTTGCGCTTGC (SEQ ID NO: 1653) for introducing the sequencing island A (SI-A) which encodes amino acids GASASGAPSTG (SEQ ID NO: 1654) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in example 5. This new library of XTEN_AM875 segment was designated LCW0481.

Example 10: Construction of XTEN_AM1318

We annealed the phosphorylated oligonucleotide BsaI-FseI-KpnIfor P: AGGTCCAGAACCAACGGGGCCGGC-CCCAAGCGGAGGTTCGTCTTCACTCGAGGGTAC (SEQ ID NO: 1655) and the non-phosphorylated oligonucleotide BsaI-FseI-KpnIrev: CCTCGAGTGAAGACGAAC-CTCCGCTTGGGGCCGGCCCCGTTGGTTCTGG (SEQ ID NO: 1656) for introducing the sequencing island B (SI-B) which encodes amino acids GPEPTGPAPSG (SEQ ID NO: 1657) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in example 5. This new library of XTEN_AM443 segments was designated LCW0480.

We generated a library of XTEN_AM1318 segments by recombining segments from library LCW0480 of XTEN_AM443 segments and segments from library LCW0481 of XTENAM875 segments using the same dimerization process as in Example 5. This new library of XTEN_AM1318 segment was designated LCW0487.

Example 11: Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12: Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13: Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full length clone of XTEN_AG864 had excellent solubility and showed half-life exceeding 60 h in cynomolgus monkeys.

Example 14: Methods of Producing and Evaluating CFXTEN with Internal and Terminal XTEN The design, construction and evaluation of CFXTEN comprising FVIII and one or more XTEN is accomplished using a systematic approach. The regions suitable for XTEN insertion sites include, but are to limited to regions at or proximal to the known domain boundaries of FVIII, exon boundaries, known surface loops, regions with a low degree of order, and hydrophilic regions. By analysis of the foregoing, different regions across the sequence of the FVIII B domain deleted (BDD) sequence have been identified as insertion sites for XTEN, non-limiting examples of which are listed in Tables 5-8, and shown schematically in FIGS. 8 and 9. Initially, individual constructs are created (using methods described, below) in which DNA encoding a single XTEN or XTEN fragment of a length ranging from 6 to 2004 amino acid residues is inserted into the FVIII sequence corresponding to or near (e.g., within 6 amino acids) each of the single insertion sites identified in Table 5, Table 6, Table 7, Table 8, and Table 9, and the resulting constructs are expressed and the recovered protein then evaluated for their effects on retention of procoagulant activity using, e.g., one of the in vitro assays of Table 49. For example, using the methods described below, constructs are made in which an XTEN sequence is inserted within the A1, A2, B, A3, C1 and C2 domain sequences of FVIII, as well as linked to the C-terminus, and the resulting expressed fusion proteins are evaluated in a chromogenic assay of Table 49, compared to a FVIII not linked to XTEN. CFXTEN fusion proteins can be further classified acting to high, intermediate and low categories based on the activities they exhibit. In those cases where the CFXTEN exhibits activity that is comparable or modestly reduced compared to FVIII, the insertion site is deemed favorable. In those cases where the activity is intermediate, the insertion site can be adjusted from 1-6 amino acids towards the N- or C-terminus of the insertion site and/or the length or net charge of the XTEN may be altered and the resulting construct(s) re-evaluated to determine whether the activity is improved. Alternatively, the XTEN is inserted into the construct with flanking cleavage sites; preferably sites that are susceptible to cleavage by proteases found in clotting assays, such that the XTEN is released during the activation of the FVIII component, thereby providing additional information about the suitability of the XTEN insertion site in the fusion protein.

Once all of the individual insertion sites are evaluated and the favorable insertion sites are identified, libraries of constructs are created with two, three, four, five or more XTEN inserted in the permutations of favorable sites. The length and net charge of the XTEN (e.g., XTEN of the AE versus AG family) are varied in order to ascertain the effects of these variables on FVIII activity and physicochemical properties of the fusion protein. CFXTEN constructs that retain a desired degree of in vitro procoagulant FVIII activity are then evaluated in vivo using mouse and/or dog models of hemophilia A, as described in Examples below, or other models known in the art. In addition, constructs are assayed in the presence of FVIII inhibitors and other anti-FVIII antibodies to determine constructs that retain activity. In addition, CFXTEN constructs are made that incorporate cleavage sequences at or near the junction(s) of FVIII and XTEN (e.g., sequences from Table 8) designed to release the XTEN and are evaluated for enhancement of FVIII activity and effects on terminal half-life. By the iterative process of making constructs combining different insertion sites, varying the length and composition qualities of the XTEN (e.g., different XTEN families), and evaluation, the skilled artisan obtains, by the foregoing methods, CFXTEN with desired properties, such as but not limited to of procoagulant FVIII activity, reduced binding with FVIII inhibitors, enhanced pharmacokinetic properties, ability to administer to a subject by different routes, and/or enhanced pharmaceutical properties.

Example 15: Methods of Producing and Evaluating CFXTEN Containing FVIII and AE_XTEN A general scheme for producing and evaluating CFXTEN compositions is presented in FIG. 15, and forms the basis for the general description of this Example. Using the disclosed methods and those known to one of ordinary skill in the art, together with guidance provided in the illustrative examples, a skilled artesian can create and evaluate CFXTEN fusion proteins comprising XTEN and FVIII or variants of FVIII known in the art. The Example is, therefore, to be construed as merely illustrative, and not limitative of the methods in any way whatsoever; numerous variations will be apparent to the ordinarily skilled artisan. In this Example, a CFXTEN of a factor VIII BDD linked to an XTEN of the AE family of motifs is created.

The general scheme for producing polynucleotides encoding XTEN is presented in FIGS. 11 and 12. FIG. 14 is a schematic flowchart of representative steps in the assembly of an XTEN polynucleotide construct in one of the embodiments of the invention. Individual oligonucleotides 501 are annealed into sequence motifs 502 such as a 12-amino acid motif ("12-mer"), which is ligated to additional sequence motifs from a library that can multimerize to create a pool that encompasses the desired length of the XTEN 504, as well as ligated to a smaller concentration of an oligo containing BbsI, and KpnI restriction sites 503. The motif libraries include specific sequence XTEN families; e.g., AD, AE, AF, AG, AM, or AQ sequences of Table 3. As illustrated in FIG. 14, the XTEN length, in this case, is 36 amino acid residues, but longer lengths are also achieved by this general process. For example, multimerization is performed by ligation, overlap extension, PCR assembly or similar cloning techniques known in the art that, in this case, result in a construct with 288 amino acid residues. The resulting pool of ligation products is gel-purified and the band with the desired length of XTEN is cut, resulting in an isolated XTEN gene with a stopper sequence 505. The XTEN gene can be cloned into a stuffer vector. In this case, the vector encodes an optional CBD sequence 506 and a GFP gene 508. Digestion is then performed with BbsI/HindIII to remove 507 and 508 and place the stop codon. The resulting product is then cloned into a BsaI/HindIII digested vector containing a gene encoding the FVIII, resulting in the gene 500 encoding a CFXTEN fusion protein with a 288 amino acid XTEN linked to the C-terminus of the factor VIII. As would be apparent to one of ordinary skill in the art, the methods are applied to create constructs in alternative configurations and with varying XTEN lengths or in multiple locations.

DNA sequences encoding FVIII are conveniently obtained by standard procedures known in the art from a cDNA library prepared from an appropriate cellular source, from a genomic library, or may be created synthetically (e.g., automated nucleic acid synthesis) using DNA sequences obtained from publicly available databases, patents, or literature references. In the present example, a FVIII B domain deleted (BDD) variant is prepared as described in Example 17. A gene or polynucleotide encoding the FVIII portion of the protein or its complement is then cloned into a construct, such as those described herein, which can be a plasmid or other vector under control of appropriate transcription and translation sequences for high level protein expression in a biological system. A second gene or polynucleotide coding for the XTEN portion or its complement is genetically fused to the nucleotides encoding the terminus of the FVIII gene by cloning it into the construct adjacent and in frame with the gene coding for the CF, through a ligation or multimerization step. In this manner, a chimeric DNA molecule coding for (or complementary to) the CFXTEN fusion protein is generated within the construct. Optionally, a gene encoding for a second XTEN is inserted and ligated in-frame internally to the nucleotides encoding the FVIII-encoding region. The constructs are designed in different configurations to encode various insertion sites of the XTEN in the FVIII sequence, including those of Table 5, Table 6, Table 7, Table 8, and Table 9 or those illustrated in FIGS. 8-9. Optionally, this chimeric DNA molecule is transferred or cloned into another construct that is a more appropriate expression vector; e.g., a vector appropriate for a mammalian host cell such as CHO, BHK and the like. At this point, a host cell capable of expressing the chimeric DNA molecule is transformed with the chimeric DNA molecule, described more completely, below, or by well-known methods, depending on the type of cellular host, as described supra.

Host cells containing the XTEN-FVIII expression vector are cultured in conventional nutrient media modified as appropriate for activating the promoter. The culture conditions, such as temperature, pH and the like, are those previously used with the host cell selected for expression, and will be apparent to the ordinarily skilled artisan. After expression of the fusion protein, culture broth is harvested and separated from the cell mass and the resulting crude extract retained for purification of the fusion protein.

Gene expression is measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, gene expression is measured by immunological of fluorescent methods, such as immunohistochemical staining of cells to quantitate directly the expression of gene product. Antibodies useful for immunohistochemical staining and/or assay of sample fluids may be either monoclonal or polyclonal, and may be prepared in any mammal. Conveniently, the antibodies may be prepared against the FVIII sequence polypeptide using a synthetic peptide based on the sequences provided herein or against exogenous sequence fused to FVIII and encoding a specific antibody epitope. Examples of selectable markers are well known to one of skill in the art and include reporters such as enhanced green fluorescent protein (EGFP), beta-galactosidase (β-gal) or chloramphenicol acetyltransferase (CAT).

The CFXTEN polypeptide product is purified via methods known in the art. Procedures such as gel filtration, affinity purification, salt fractionation, ion exchange chromatography, size exclusion chromatography, hydroxyapatite adsorption chromatography, hydrophobic interaction chromatography or gel electrophoresis are all techniques that may be used in the purification. Specific methods of purification are described in Robert K. Scopes, Protein Purification: Principles and Practice, Charles R. Castor, ed., Springer-Verlag 1994, and Sambrook, et al., supra. Multistep purification separations are also described in Baron, et al., Crit. Rev. Biotechnol. 10:179-90 (1990) and Below, et al., J. Chromatogr. A. 679:67-83 (1994).

As illustrated in FIG. 15, the isolated CFXTEN fusion proteins are characterized for their chemical and activity properties. An isolated fusion protein is characterized, e.g., for sequence, purity, apparent molecular weight, solubility and stability using standard methods known in the art. The fusion protein meeting expected standards is evaluated for activity, which can be measured in vitro or in vivo by measuring one of the factor VIII-associated parameters described herein, using one or more assays disclosed herein, or using the assays of the Examples or Table 49.

In addition, the CFXTEN FVIII fusion protein is administered to one or more animal species to determine standard pharmacokinetic parameters and pharmacodynamic properties, as described in Examples 25 and 26.

By the iterative process of producing, expressing, and recovering CFXTEN constructs, followed by their characterization using methods disclosed herein or others known in the art, the CFXTEN compositions comprising CF and an XTEN are produced and evaluated to confirm the expected properties such as enhanced solubility, enhanced stability, improved pharmacokinetics and reduced immunogenicity, leading to an overall enhanced therapeutic activity compared to the corresponding unfused FVIII. For those fusion proteins not possessing the desired properties, a different sequence or configuration is constructed, expressed, isolated and evaluated by these methods in order to obtain a composition with such properties.

Example 16: Construction of Expression Plasmids for BDD FVIII

I. Construction of B Domain Deleted FVIII (BDD FVIII) Expression Vectors

The expression vector encoding BDD FVIII was created by cloning the BDD FVIII open reading frame into the pcDNA4 vector (Invitrogen, CA) containing a polyA to allow for optimal mammalian expression of the FVIII gene, resulting in a construct designated pBC0100. Several natural sites were identified within this construct for cloning use, including BsiWI 48, AflII 381, PshAI 1098, KpnI 1873, BamHI 1931, PflMI 3094, Apa13574, XbaI 4325, NotI 4437, XhoI 4444, BstEII 4449, AgeI 4500, PmeI 4527. To facilitate assay development, nucleotides encoding Myc and His tag were introduced into the FVIII open reading frame. pBC0100 was PCR amplified using the following primers: 1) F8-BsiWI-FI: tattccCGTACGgccgccaccATGCAAATA-GAGCTCTCCACCT (SEQ ID NO: 1658); 2) F8-nostop-XhoI-R1: GGTGACCTCGAGcgtagaggtcctgtgcctcg (SEQ ID NO: 1659) to introduce BsiWI and XhoI in appropriate locations. The PCR product was digested with BsiWI and XhoI. PcDNA4-Myc-His/C was digested with Acc65I and XhoI, which generated two products of 5003 and 68 bps. The 5003 bps product was ligated with the digested PCR'ed FVIII fragment and used for DHSalpha transformation. The enzymes Acc65I and BsiWI create compatible ends but this ligation destroys the site for future digestion. The resulting construct was designated pBC0102 (pcDNA4-FVIII_3-Myc-His). To facilitate the design and execution of future cloning strategies, especially ones involving the creation of BDD FVIII expression constructs that contain multiple XTEN insertions, we selected additional unique restriction enzyme sites to incorporate, including BsiWI 908, NheI 1829 and ClaI 3281. The introduction of these sites was done via the QuikChange method (Agilent, CA) individually. The resulting construct was designated pBC0112 (pcDNA4-FVIII_4-Myc-His). To avoid problems that may arise from the linker peptides that connects between Myc/His and FVIII/Myc, and to remove restriction enzyme sites that are preferred for future XTEN insertion, we mutated the sequences encoding the peptide sequences from ARGHPF (SEQ ID NO: 1660) to GAGSPGAETA (SEQ ID NO: 178) (between FVIII and Myc), NMHTG (SEQ ID NO: 1661) to SPATG (SEQ ID NO: 1662) (between Myc and His) via the QuikChange method. The construct was designated pBC0114 (pcDNA4-FVIII_4-GAGSPGAETA-Myc-SPATG-His ('GAGSPGAETA' and 'SPATG' disclosed as SEQ ID NOS 178 and 1662, respectively)) (sequence in Table 21), which was used as the base vector for the design and creation of other expression vectors incorporating XTEN sequences. Expression and FVIII activity data for this construct are presented in II. Construction of B Domain Deleted FVIII (BDD FVIII) Expression Vectors The gene encoding BDD FVIII is synthesized by GeneArts (Regensburg, Germany) in the cloning vector pMK (pMK-BDD FVIII). The BDD FVIII proteins contain 1457 amino acids at a total molecular weight of 167539.66. There are 6 domains within the wild-type FVIII protein, the A1, A2, B, A3, C1 and C2 domains. In the BDD FVIII protein, most of the B domain has been deleted as it was shown to be an unstructured domain and the removal of the domain does not alter critical functions of this protein. The pMK vector used by GeneArts contains no promoter, and can not be used as an expression vector. Restriction enzyme sites NheI on the 5' end and SfiI, SalI and XhoI on the 3' end are introduced to facilitate subcloning of the DNA sequence encoding BDD FVIII into expression vectors, such as CET1019-HS (Millipore). Several unique restriction enzyme sites are also introduced into the FVIII sequence to allow further manipulation (e.g., insertion, mutagenesis) of the DNA sequences. Unique sites listed with their cut site include, but are not limited to: SacI 391, AfiII 700, SpeI 966, PshAI 1417, Acc6512192, KpnI 2192, BamHI 2250, HindIII 2658, PfoI 2960, PflMI 3413, Apa13893, Bsp1201 3893, SwaI 4265, OliI 4626, XbaI 4644, and BstBI 4673. The HindIII site resides at the very end of the A2 domain and can potentially be used for modification of the B domain. The synthesized pMK-BDD FVIII from GeneArts does not contain a stop codon. The stop codon is introduced by amplifying a 127 bp fragment of FVIII using the following primers: 5'-GTGAACTCTCTAGACCCACCG-3' (SEQ ID NO: 1663); 5'-CTCCTCGAGGTCGACTCAGTAGAG-GTCCTGTGCCTCG-3' (SEQ ID NO: 1664). The fragment is digested with XbaI and SalI, and ligated to XbaI/SalI digested pMK-BDD FVIII. The ligated DNA mixture is used to transform DH5a bacterial cells. Transformants are screened by DNA miniprep and the desired constructs are confirmed by DNA sequencing. The construct named pBC0027 (pMK-BDD FVIII-STOP) contains coding sequences that encode the BDD FVIII protein. The pBC0027 construct is then digested with NheI/SalI, and ligated with NheI/SalI digested CET1019-HS vector (Millipore). The CET1019-HS vector contains a human CMV promoter and a UCOE sequence to facilitate gene expression. The ligated DNA mixture is used to transform DH5a bacterial cells. Transformants are screened by DNA miniprep and the desired constructs are confirmed by DNA sequencing. The final construct is designated pBC0025 (CET1019-HS-BDD FVIII-STOP), which encodes the BDD FVIII protein under the control of a human CMV promoter. Introduction of the pBC0025 construct into mammalian cells is expected to allow expression of the BDD FVIII protein with procoagulant activity.

Example 17: Construction of Expression Plasmids for BDD FVIII Containing XTEN

1. B Domain AE42 Insertion

Two PCR reactions were run in parallel to insert XTEN_AE42 into the remaining B domain region of the BDD FVIII constructs. The PCR reactions involved the following primers: cgaaagcgctacgcctgagaGTGGCCCTGGCTCT-GAGCCAGCCACCTCCGGCTCTGAAACCCCTGCCTCGAGCccaccagtcttgaaacgcc (SEQ ID NO: 1665); TGA-TATGGTATCATCATAATCGATTTCCTCTTGATCT-GACTG (SEQ ID NO: 1666); agcttgaggatccagagttc (SEQ ID NO: 1667); tctcaggcgtagcgctttcgCTTGTCCCCTCT-TCTGTTGAGGTGGGGGAGCCAGCAGGAGAACCTG-GCG CGCCgttttgagagaagcttcttggt (SEQ ID NO: 1668). The PCR products then served as templates, and a second PCR was performed to introduce the XTEN_AE42 into the FVIII encoding nucleotide sequences flanked by BamHI and ClaI. This PCR product was digested with BamHI and ClaI simultaneously with the digestion of PBC0114 with the same two enzymes. The PCR product was ligated to the digested vector. This construct was designated pBC0135 (pcDNA4-FVIII_4 XTEN_AE42-GAGSPGAETA-Myc-SPATG-His) ('GAGSPGAETA' and 'SPATG' disclosed as SEQ ID NOS178 and 1662, respectively), and encodes the BDD FVIII with an AE42 XTEN incorporated within the residual B-domain.

2. AE42 Insertion and R1648A Mutation

The QuikChange method (Agilent, CA) was employed to introduce an R1648A mutation into PBC0135. This construct was designated pBC0149 (pcDNA4-FVIII_4 XTEN_AE42-GAGSPGAETA-Myc-SPATG-His_R1648A) ('GAGSPGAETA' and 'SPATG' disclosed as SEQ ID NOS178 and 1662, respectively), eliminating that FVIII processing site.

3. B Domain AE288 Insertion

XTEN_AE288 was PCR amplified using the following primers: tctcaaaacGGCGCGCCAggtacctcagagtctgctacc (SEQ ID NO: 1669) and tggtggGCTCGAGGCtggcgcactgccttc (SEQ ID NO: 1670). PBC0075 was used as the template for this PCR reaction. The PCR product was digested with AscI and XhoI, and PBC0135 was digested with the same enzymes. The PCR product was ligated to the PBC0135 fragment. This construct was designated pBC0136 (pcDNA4-FVIII_4 XTEN_AE288-GAGSPGAETA-Myc-SPATG-His) ('GAGSPGAETA' and 'SPATG' disclosed as SEQ ID NOS178 and 1662, respectively), and encodes the BDD FVIII with an AE288 XTEN incorporated within the residual B-domain.

4. AE288 Insertion and R1648A Mutation

XTEN_AE288 was PCR amplified using the following primers: tctcaaaacGGCGCGCCAggtacctcagagtctgctacc (SEQ ID NO: 1671) and tggtggGCTCGAGGCtggcgcactgccttc (SEQ ID NO: 1672). Construct pBC0075 was used as the template for this PCR reaction. The PCR product was digested with AscI and XhoI, and pBC0149 was digested with the same enzymes. The PCR product was ligated to the pBC0149 fragment. This construct was designated pBC0137 (pcDNA4-FVIII_4 XTEN_AE288-GAGSPGAETA-Myc-SPATG-His R1648A) ('GAGSPGAETA' and 'SPATG' disclosed as SEQ ID NOS178 and 1662, respectively) and contains an AE288 XTEN sequence internal to the B domain, with the R1648A mutation eliminating that FVIII processing site.

3. B Domain AE144, AG144, AG288 Insertions with and without R1648A Mutations

Select XTEN fragments were PCR amplified to introduce AscI and XhoI sites to the 5' and 3' end respectively. The PCR product was digested with AscI and XhoI, and pBC0135 (for R1648) or pBC0149 (for A1648) were digested with the same enzymes. The PCR product was ligated to the pBC0135 or pBC0149 vector. These constructs were designated pSD0005, 6, 7, 8, 17 and 18.

Construction of Expression Plasmids for BDD FVIII with XTEN Insertion at the C Terminus 1. C Terminal AE288 Insertion XTEN_AE288 was PCR amplified using the following primers: ggggccgaaacggccggtacctcagagtctgctacc (SEQ ID NO: 1673) and tgttcggccgtttcggccccctggcgcactgccttc (SEQ ID NO: 1674). The construct pBC0075 was used as the template for this PCR reaction. The PCR product was digested with SfiI, and pBC0114 was digested with the same enzyme. The PCR product was ligated to the digested pBC0114 fragment. This construct was designated pBC0145 (pcDNA4-FVIII_4-XTEN_AE288-GAGSPGAETA-Myc-SPATG-His) ('GAGSPGAETA' and 'SPATG' disclosed as SEQ ID NOS178 and 1662, respectively), and encodes an AE288 sequence at the C-terminus of the BDD FVIII.

2. C Terminal AG288 Insertion

XTEN_AG288 was designed and synthesized by DNA2.0 (Menlo Park, Calif.). The synthesized gene was PCR amplified using the following primers: ggggccgaaacggc-cccggggagcgtcacc (SEQ ID NO: 1675) and tgttcggccgtttcg-gcccctgacccggttgcccc (SEQ ID NO: 1676). The PCR product was digested with SfiI, and PBC0114 based vector was digested with the same enzyme. The PCR product was ligated to the digested PBC0114 fragment. This construct was designated pBC0146 (pcDNA4-FVIII_4-XTEN_AG288-GAGSPGAETA-Myc-SPATG-His) ('GAG-SPGAETA' and 'SPATG' disclosed as SEQ ID NOS178 and 1662, respectively), and encodes an AG288 sequence at the C-terminus of the BDD FVIII.

3. C Terminal AE/AG144, 288, 864 Insertions

AscI and XhoI sites were introduced into the PBC0114 based vector via QuikChange methods using the primers: 5037-PBC0114-AscI-XhoI-F: CAGGACCTCTACG-GCGCGccagcctcgaGCGAACAAAACTCATCTCA-GAAGAGG (SEQ ID NO: 1677); 5038-PBC0114-AscI-XhoI-R: CCTCTTCTGAGATGAGTTTTTGTTCGCtcgaggctg-gcGCGCCGTAGAGGTCCTG (SEQ ID NO: 1678). Various XTEN fragments were PCR amplified with AscI and XhoI introduced into the 5' and 3' end respectively. The PCR product was ligated to the digested PBC0114 vector. These constructs were designated pSD0013, pSD0014, pSD0015, pSD0016, pSD0019 and pSD0020.

Construction of Expression Plasmids for BDD FVIII with Inter- and Intra-Domain XTEN Insertions 1. AE7, AE42 and AE144 Insertions Four distinct strategies are used for insertion of AE42 into the designated sites (e.g., the natural or introduced restriction sites BsiWI 48, AflII 381, PshAI 1098, KpnI 1873, BamHI 1931, PflMI 3094, Apa13574, XbaI 4325, NotI 4437, XhoI 4444, BstEII 4449, AgeI 4500, PmeI 4527, BsiWI 908, NheI 1829 and ClaI 3281) within the BDD FVIII encoding sequence, each contributing to the creation of several constructs. By design, these insertions of AE42 create AscI and XhoI sites flanked on either side of the insertion allowing for introduction/substitution of longer XTENs, as well as XTEN with different sequences or incorporated cleavage sequences, as needed. Specifically, the constructs that contain XTEN_144 insertions are listed in Table 21. These insertions were created by replacing either AE7 or AE42 with a PCRed XTEN_144 fragment flanked by AscI and XhoI sites.

2. Double PCR-Mediated Method

Two PCR reactions are run in parallel to insert XTEN_AE42 into the designated site. The two PCR reactions introduce XTEN on either the 3' or the 5' end via use of a long primer that contains partial XTEN. The PCR products then serve as templates, and a second PCR is performed to introduce the XTEN_AE42 into the FVIII encoding nucleotide sequences flanked by select restriction enzyme sites. This PCR product is digested with the appropriate enzymes simultaneously with the digestion of PBC0114 using the same two enzymes. The PCR product is ligated to the digested vector. Using this method, constructs are created designated pBC0126, pBC0127, pBC0128, and pBC0129, resulting in AE42 insertions at the R3, R3, P130, L216 locations respectively. The sequences are listed in Table 21. Select XTEN_144 sequences can then be PCRed to introduce AscI and XhoI sites on either end of the fragment, and ligate to digested FVIII-XTEN_AE42 construct. For instance, pSD0053 was created by replacing the AE42 of pBC0129 with XTEN_AE144. Other XTEN_144 constructs were created via the same strategy and are listed in Table 21.

3. QuikChange Mediated Two Step Cloning Method

The QuikChange method is employed to introduce XTEN_AE7 encoding sequences that are flanked by AscI and XhoI into designated sites. The resulting intermediate construct is then digested with AscI and XhoI. XTEN_AE42 or XTEN_AE144 is PCR amplified to introduce the two sites and digested accordingly. The vector and insert are then ligated to create the final constructs. The sequences are listed in Table 21.

4. Three PCR Type II Restriction Enzyme Mediated Ligation Method

Three PCR reactions are performed to create two pieces of FVIII encoding fragments flanked by one type I restriction enzyme that correlates with a unique site within the FVIII_4 gene and one type II enzyme (e.g. BsaI, BbsI, BfuAI), the third PCR reaction created the XTEN_AE42 flanked by two type II restriction enzyme sites. The three PCR fragments are digested with appropriate enzymes and ligated into one linear piece that contains the XTEN_AE42 insertion within a fragment of FVIII encoding sequences. This product is then digested with appropriate unique enzymes within the FVIII encoding sequences and ligated to the PBC0114 construct digested with the same enzymes, and result in constructs designated pBC0130 (with XTEN insertion at residue P333), pBC0132 (with XTEN insertion at residue D403), pBC0133 (with XTEN insertion at residue R490). The sequences are listed in Table 21. Select XTEN_144 sequences can then be PCRed to introduce AscI and XhoI sites on either end of the fragment, and ligate to digested FVIII-XTEN_AE42 construct. For instance, pSD0001 and pSD0003 were created by replacing the AE42 of pBC0132 with XTEN_AE144 and XTEN_AG144 respectively. Other XTEN_144 constructs listed in Table 21 were created via the same strategy.

5. Custom Gene Synthesis

Custom gene synthesis is performed by GeneArt (Regensburg, Germany). The genes are designed so that they include nucleotides encoding the XTEN_AE42 inserted in the designated site(s) and the genes are flanked by two unique restriction enzyme sites selected within the FVIII_4 gene. The synthesized genes and PBC0114 are digested with appropriate enzymes and ligated to create the final product with the BDD FVIII incorporating the XTEN_AE42 between the restriction sites. Select XTEN_144 sequences can then be PCRed to introduce AscI and XhoI sites on either end of the fragment, and ligate to digested FVIII-XTEN_AE42 construct.

Construction of Expression Plasmids with Dual XTEN Insertions in the B Domain and at the C Terminus The construct pBC0136, which encodes the BDD FVIII with an AE288 XTEN incorporated within the residual B-domain, is digested with BamHI and ClaI, and the resulting 1372 bps fragment from this digestion is the insert. The construct pBC0146 is digested with BamHI and ClaI, and the 9791 bps piece from this digestion is the vector. The vector and insert are ligated together to create pBC0209, containing an AE288 insertion within the B domain and an AG288 on the C terminus. The same strategy is utilized to create constructs containing two AE288 insertions in the B domain and at the C terminus, respectively, using PBC0145 as the vector.

Construction of Expression Plasmids with Multiple XTEN Insertions

The construct pBC0127, which encodes an AE42 XTEN at the R3 position of FVIII, is digested with BsiWI and AflII, and the resulting 468 bps fragment from this digestion is the insert. The construct pBC0209 is digested with BsiWI and AflII, the 10830 bps piece from this digestion is the vector. The vector and insert are ligated together to create a construct designated pBC0210, containing an AE42 insertion in the A1 domain, an extra three ATR amino acid to restore the signal cleavage sequence, an AE288 XTEN insertion within the B domain and an AG288 on the C terminus. The same methodology is used to create constructs encoding multiple XTEN at the natural and introduced restriction sites; e.g., BsiWI 48, AflII 381, PshAI 1098, KpnI 1873, BamHI 1931, PflMI 3094, Apa13574, XbaI 4325, NotI 4437, XhoI 4444, BstEII 4449, AgeI 4500, PmeI 4527, BsiWI 908, NheI 1829 and ClaI 3281.

Construction of BDD FVIII-Internal-XTEN_AE288 Expression Vectors

Two BsaI restriction enzyme sites are introduced into the PBC0027 pMK-BDD FVIII construct between the base pair 2673 and 2674 using the QuikChange method following manufacturer's protocol (Agilent Technologies, CA). The inserted DNA sequences are gggtctcccgcgccagggtctccc, and the resulting construct is designated pBC0205 (sequence in Table 21). The DNA sequence encoding AE288 (or other variants and lengths of XTEN; e.g. AE42, AG42, AG288, AM288) is then PCR'ed with primers that introduce BsaI sites on both the 5' and 3'. The pBC0205 vector and the insert (XTEN_288) are then digested with BsaI and ligated to create pBC0206, which encodes the FVIII gene with an XTEN_AE288 insertion within the B domain (sequence in Table 21). The pBC0206 construct is then digested with NheI/SalI, and ligated with NheI/SalI digested CET1019-HS vector (Millipore). The CET1019-HS vector contains a human CMV promoter and a UCOE sequence to facilitate gene expression. The ligated DNA mixture is used to transform DH5a bacterial cells. Transformants are screened by DNA miniprep and the desired constructs are confirmed by DNA sequencing. The final construct is designated pBC0207 (CET1019-HS-BDD FVIII-STOP), which encodes the BDD FVIII protein under the control of a human CMV promoter (sequence in Table 21). Introduction of the pBC0207 construct into mammalian cells is expected to allow expression of the BDD FVIII protein with an internal XTEN_AE288. The same protocol is used to introduce, transform and express constructs containing other variants and lengths of XTEN; e.g. AE42, AG42, AG288, AM288, AE864, AG864, or other XTEN of Table 4.

Construction of BDD FVIII-/-XTEN_AE864 Expression Vectors

The BDD FVIII fragment with NheI and SfiI flanking the 5' and 3' end is generated by digesting the pBC0025 construct. This digested fragment is then ligated to a NheI/SfiI digested pSecTag vector (pBC0048 pSecTag-FVIII-/-XTEN_AE864) encoding the FVIII followed by the XTE- N_AE864 sequence. The ligated DNA mixture is used to transform DH5a bacterial cells. Transformants are screened by DNA miniprep and the desired constructs are confirmed by DNA sequencing. The final construct is pBC0060, which encodes the BDD FVIII-/-XTEN_AE864 protein under the control of a human CMV promoter. Introduction of the pBC0060 construct into mammalian cells is expected to express the FVIII protein with a C terminal XTEN fusion (BDD FVIII-/-XTEN_AE864) with procoagulant activity.

Construction of BDD FVIII-/FXI/-XTEN_AE864 Expression Vectors

The BDD FVIII fragment with NheI and SfiI flanking the 5' and 3' end is generated by digesting the pBC0025 construct. This digested fragment is then ligated to a NheI/SfiI digested pSecTag vector (pBC0047 pSecTag-FVIII-/FXI/-XTEN_AE864) encoding the FVIII followed by the FXI cleavage sequence (/FXI/) and XTEN_AE864. The ligated DNA mixture is used to transform DH5a bacterial cells. Transformants are screened by DNA miniprep and the desired constructs are confirmed by DNA sequencing. The final construct is pBC0051, which encodes the BDD FVIII-/FXI/-XTEN_AE864 protein under the control of a human CMV promoter. Introduction of the pBC0051 construct into mammalian cells is expected to express the FVIII protein with a C terminal XTEN fusion (BDD FVIII-/FXI/-XTEN_AE864), which could be subsequently cleaved by FXI, therefore liberating the BDD FVIII protein with procoagulant activity.

Construction of BDD FVIII-/FXI/-XTEN Expression Vectors Comprising AE288 or AG288

The fused AE864 XTEN sequence in pBC0060 is replaced by digesting the XTEN sequences AE288 and AG288 with BsaI and HindIII. A subsequent ligation step using the respective AE288 or AG288 XTEN fragment and BsaI/HindIII digested pBC0051 allows the exchange of the AE288 or AG288 sequences into the BDD FVIII expression vector. The resulting final constructs are pBC0061 for BDD FVIII-AE288 and pBC0062 for BDD FVIII-AG288. Introduction of the pBC0061 construct into mammalian cells is expected to express the FVIII protein with a C-terminal AE288 XTEN fusion (BDD FVIII-/-XTEN_AE288) with procoagulant activity. Introduction of the pBC0062 construct into mammalian cells is expected to express the FVIII protein with a C-terminal AG288 XTEN fusion (BDD FVIII-/-XTEN_AG288) with procoagulant activity.

Construction of BDD FVIII-/FXI/-XTEN Expression Vectors with Alternate XTEN

The fused XTEN sequence in pBC0051 is replaced by digesting DNA encoding other XTEN sequences (e.g. other variants and lengths of XTEN; e.g. AE42, AG42, AG288, AM288) with BsaI and HindIII. A ligation using the XTEN fragment and BsaI/HindIII digested pBC0051 allows the exchange of the various XTEN-encoding sequences into the BDD FVIII expression vector, providing the alternate constructs. Introduction of the alternate constructs into mammalian cells is expected to express the FVIII protein with a C-terminal XTEN (BDD FVIII-/FXI/-XTEN) that can be subsequently cleaved by FXI, releasing the FVIII, resulting in procoagulant FVIII fusion with procoagulant activity.

Example 18: Construction of Expression Plasmids for FVIII Signal Peptide-XTEN-/FXI/-BDD FVIII Construction of Expression Vectors for FVIII Signal Peptide-XTEN_AE864

The coding sequences for the FVIII signal peptide is generated by annealing the following two oligos: 5'-CTAG-CATGCAAATAGAGCTCTCCACCTGCTTCTTTCTGT-GCCTTTTGCGATTCTGCTTTAGTG GGTCTCC-3' (SEQ ID NO: 1679); 5'-ACCTGGAGACCCACTAAAGCA-GAATCGCAAAAGGCACAGAAAGAAGCAGGTGGA-GAGCTC TATTTGCATG-3' (SEQ ID NO: 1680). The annealed oligos are flanked by the NheI and BsaI restriction enzyme sites on either end, and is ligated to NheI/BsaI digested pCW0645 vector which encodes the FVII-XTE-N_AE864. The ligated DNA mixture is used to transform DH5a bacterial cells. Transformants is screened by DNA miniprep and the desired constructs are confirmed by DNA sequencing. The final construct is designated pBC0029, which encodes the signal peptide-XTEN_AE864 protein under the control of a human CMV promoter. This construct is used as an intermediate construct for creating an expression construct with XTEN fused on the N-terminus of the FVIII protein, and can also be used as a master plasmid for creating expression constructs that allow XTEN fusion on the N-terminus of a secreted protein.

Construction of Signal Peptide-XTEN_AE864-/FXI/-BDD FVIII Expression Vectors

An 1800 bp fragment within the FVIII coding region is amplified using primers that introduce NheI-BbsI-/FXI/-AgeI sites on the 5' and endogenous KpnI restriction enzyme on the 3' end. The NheI/KpnI digested FVIII fragment is ligated with NheI/KpnI digested pBC0027 vector. The ligated DNA mixture is used to transform DH5a bacterial cells. Transformants are screened by DNA miniprep and the desired constructs are confirmed by DNA sequencing. The resulting construct is designated pBC0052, which contains sequences that encode the /FXI/-FVIII protein without the FVIII signal peptide. This construct is used as an intermediate construct for creating an expression construct with XTEN fused on the N-terminus of the FVIII protein.

The pBC0052 vector is digested with BbsI/XhoI enzymes, and is used to ligate with BbsI/XhoI digested pBC0029. The ligated DNA mixture is used to transform DH5a bacterial cells. Transformants are screened by DNA miniprep and the desired constructs are confirmed by DNA sequencing. The final construct is designated pBC0053, which encodes the signal peptide-XTEN_AE864-/FXI/-BDD FVIII protein under the control of a human CMV promoter. Introduction of the pBC0053 construct into mammalian cells is expected to express the FVIII protein with an N-terminal XTEN fusion (signal peptide-XTEN_AE864-/FXI/-BDD FVIII), which could be subsequently cleaved by FXI, therefore liberating the BDD FVIII protein.

Construction of Signal Peptide-XTEN-/FXI/-BDD FVIII Expression Vectors

The fused XTEN sequence in pBC0053 can be replaced by digesting other XTEN fragments (e.g. AM, AF, AG) with BsaI and BbsI. A ligation using the XTEN fragment and BsaI/BbsI digested pBC0053 allows the exchange of various XTEN pieces (e.g. AM, AF, AG) into the BDD FVIII expression vector. Various XTEN fusions can increase the half lives of these proteins differently, allowing modification of the properties (e.g. efficacy, potency) of these proteins. Introduction of any of these fusion constructs into mammalian cells is expected to express the FVIII protein with an N-terminal XTEN fusion (signal peptide-XTEN-/FXI/-BDD FVIII), in which the fused XTEN peptide can be subsequently cleaved by FXI, generating the BDD FVIII protein.

Example 19: Construction of BDD FVIII with Interdomain XTEN Insertion

Construction of BDD FVIII Expression Vectors with an XTEN Insertion at the A2-B Domain Boundaries The pBC0027 construct (pMK-BDD FVIII-STOP) is a cloning vector designed to contain the BDD FVIII protein coding sequences, but not a promoter positioned to initiate the expression of BDD FVIII. This construct is used for manipulation of the coding sequences of BDD FVIII as the vector backbone contains very few restriction enzyme sites. therefore allowing easy cloning strategies. The BDD FVIII proteins contain 1457 amino acids at a total molecular weight of 167539.66. There are 6 domains within the wild-type FVIII protein, the A1, A2, B, A3, C1 and C2 domains. In the BDD FVIII protein, most of the B domain has been deleted as it is believed to be an unstructured domain and the removal of the domain does not alter critical functions of this protein. However, the B domain boundaries seem to be excellent positions for creating XTEN fusions to allow extension of the protein half lives.

Within the pBC0027 construct, there is a unique HindIII restriction enzyme site at the boundary of A2-B junction. The XTEN (e.g., sequences of Tables 4, or 13-17) are amplified using primers that introduce a HindIII and FXI cleavage site on either end of the XTEN coding sequence. The fused XTEN sequence can be altered by amplifying various XTEN fragments. Various XTEN fusions can increase the half lives of these proteins differently, allowing modification of the properties (e.g. efficacy, potency) of these proteins. The HindIII-/FXI/-XTEN-/FXI/-HindIII fragment is digested with HindIII and ligated with HindIII digested pBC0027. The ligated DNA mixture is used to transform DH5a bacterial cells. Transformants are screened by DNA miniprep and the desired constructs are confirmed by DNA sequencing. The final construct is designated pBC0054, which encodes the BDD FVIII protein with an interdomain XTEN fusion (FVIII(A1-A2)-/FXI/-XTEN-/FXI/-FVIII(C1-C2)) but not a promoter to initiate gene expression.

The pBC0054 construct is digested with NheI/SalI, and ligated with NheI/SalI digested CET1019-HS vector (Millipore). The CET1019-HS vector contains a human CMV promoter and a UCOE sequence to facilitate gene expression. The ligated DNA mixture is used to transform DH5a bacterial cells. Transformants are screened by DNA miniprep and the desired constructs are confirmed by DNA sequencing. The final construct is designated pBC0055 (CET1019-HS-FVIII(A1-A2)-/FXI/-XTEN-/FXI/-FVIII (C1-C2)), which encodes the BDD FVIII protein with an interdomain (inter-A2/B domain) XTEN fusion (FVIII(A1-A2)-/FXI/-XTEN-/FXI/-FVIII(C1-C2)) under the control of a human CMV promoter. Introduction of the pBC0055 construct into mammalian cells is expected to express the BDD FVIII protein with an interdomain XTEN fusion (FVIII(A1-A2)-/FXI/-XTEN-/FXI/-FVIII(C1-C2)), which could be subsequently cleaved by FXI, therefore liberating the BDD FVIII protein.

Construction of BDD FVIII Expression Vectors with an XTEN Insertion at the A1-A2 Domain Boundaries The pBC0027 construct is designed as a template for two PCR reactions using the following four primers:

```
(Reaction I)
                                          (SEQ ID NO: 1681)
5'-ATGATGGCATGGAAGCCTAT-3';

(SEQ ID NO: 1682)
5'-ATCCCTCACCTTCGCCAGAACCTTCAGAACCCTCACCTTCAGAACCT

TCACCAGAACCTTCACCATCTTCCGCTTCTTCATTATTTTTCAT-3'.

(Reaction II)
                                          (SEQ ID NO: 1683)
5'-TTCTGGCGAAGGTGAGGGATCTGAAGGCGGTTCTGAAGGTGAAGGTG

GCTCTGAGGGTTCCGAATATGATGATGATCTTACTGATTCTGAAAT-3';

(SEQ ID NO: 1684)
5'-TATTCTCTGTGAGGTACCAGC-3'.
```

The PCR products generated are 150 bps and 800 bps respectively. The 800 bp product is used as the template for the next round of PCR reaction with the 150 bp product as one primer and 5'-TATTCTCTGTGAGGTACCAGC-3' (SEQ ID NO: 1685) as the other. The product for the second round of PCR is 930 bps and is digested with PshAI and ACC65I restriction enzymes. This PshAI/Acc65I flanked DNA fragment is ligated with PshAI/Acc65I digested pBC0027. The ligated DNA mixture is used to transform DH5a bacterial cells. Transformants is screened by DNA miniprep and the desired constructs are confirmed by DNA sequencing. The final construct is designated pBC0058 (pMK-BDD FVIII-D345-XTEN_Y36), which encodes the BDD FVIII protein with an interdomain (inter-A1/A2 domain) XTEN fusion after the D345 residue.

The pBC0058 construct is digested with NheI/SalI, and ligated with NheI/SalI digested CET1019-HS vector (Millipore). The CET1019-HS vector contains a human CMV promoter and a UCOE sequence to facilitate gene expression. The ligated DNA mixture is used to transform DH5a bacterial cells. Transformants are screened by DNA miniprep and the desired constructs are confirmed by DNA sequencing. The final construct is designated pBC0059 (CET1019-HS-BDD FVIII D345-XTENY36), which encodes the BDD FVIII protein with an interdomain (inter-A1/A2 domain) XTEN fusion after the D345 residue under the control of a human CMV promoter. Introduction of the pBC0059 construct into mammalian cells is expected to express the BDD FVIII protein with an interdomain XTEN fusion (BDD FVIII D345-XTEN_Y36).

Example 20: Construction of FVIII with Intradomain XTEN Insertion

Construction of BDD FVIII Expression Vectors with an XTEN Insertion after P598 (within the A2 Domain)

The coding sequences for XTEN_Y36 is amplified using PCR techniques with the following primers: 5'-GAAGCTG-GTACCTCACAGAGAATATACAACGCTTTCTC-CCCAATCCAGGTGAAGGTTCTGGT GAAGG-3' (SEQ ID NO: 1686) 5'-AACTCTGGATCCTCAAGCTGCACTC-CAGCTTCGGAACCCTCAGAGCC-3' (SEQ ID NO: 1687).

The 184 bp PCR product is flanked by the KpnI and BamHI restriction enzyme sites on either end, and is ligated to KpnII/BamHI digested pBC0027 vector which encodes the BDD FVIII gene. The ligated DNA mixture is used to transform DH5a bacterial cells. Transformants are screened by DNA miniprep and the desired constructs are confirmed by DNA sequencing. The final construct is designated pBC0056, which contains DNA sequences encoding the FVIII protein with an XTEN_Y36 fusion after the P598 residue. This cloning strategy is used to introduce various forms of XTEN into the BDD FVIII protein by altering the template for the PCR reaction and changing the primers accordingly.

The pBC0056 construct is digested with NheI/SalI, and ligated with NheI/SalI digested CET1019-HS vector (Millipore). The CET1019-HS vector contains a human CMV promoter and a UCOE sequence to facilitate gene expression. The ligated DNA mixture is used to transform DH5a bacterial cells. Transformants are screened by DNA miniprep and the desired constructs are confirmed by DNA sequencing. The final construct is designated pBC0057 (CET1019-HS-FVIII P598-XTEN_Y32), which encodes the BDD FVIII protein with an intradomain (within A2 domain) XTEN fusion under the control of a human CMV promoter. Introduction of the pBC0057 construct into mammalian cells is expected to express the BDD FVIII protein with an intradomain XTEN fusion (FVIII P598-XTEN_Y32).

Construction of BDD FVIII Expression Vectors with Other Intradomain XTEN Insertions To introduce various XTEN segments into other intradomain sites within BDD FVIII (e.g., the XTEN of Tables 4, or 13-17), primers are designed that amplify XTEN with an overhang that can anneal with BDD FVIII. The coding sequence of FVIII (pMK-BDD FVIII) is designed with various unique restriction enzyme sites to allow these specific insertions. The unique restriction enzymes are listed below with their cut site: NheI 376, SacI 391, AflII 700, SpeI 966, PshAI 1417, Acc65I 2192, KpnI 2192, BamHI 2250, HindIII 2658, PfoI 2960, PflMI 3413, Apa13893, Bsp1201 3893, SwaI 4265, OliI 4626, XbaI 4644, BstBI 4673, SalI4756, and XhoI 4762. The NheI and SalI sites on either end of the coding sequence are used to insert the DNA fragment into a human CMV promoter driven vector, the CET1019-HS (Millipore) for expression in mammalian cells. These constructs express the BDD FVIII protein with an XTEN fusion with sequences listed in Table 21.

Example 21: Construction of FVIII with XTEN Insertions

CFXTEN with Two XTEN:

To obtain CFXTEN with two XTEN insertions in various regions (from N-termini to C-termini: A1-R1, A1-R2, A2-R1, A2-R2, B domain, a3, A3-R1, A3-R2, C-termini), constructs that expressed fusions with single-XTEN insertions that retained FVIII activity were utilized. The coding sequence of FVIII (pBC0114 pcDNA4-FVIII_4-X10-Myc-SPATG-His extra RE) ('SPATG' disclosed as SEQ ID NO: 1662) was designed with various unique restriction enzyme sites to allow these specific combinations. The unique restriction enzymes are listed in Table 18 below with their relative sites between different regions: BsiWI (between N-termini and A1-R1), AflII (between A1-R1 and A1-R2), NheI (between A1-R2 and A2-R1), KpnI (between A2-R1 and A2-R2), BamHI (between A2-R2 and B domain), ClaI (between a3 and A3-R1), PflMI (between A3-R1 and A3-R2), XbaI (between A3-R2 and C-termini), AgeI (between FVIII C-termini and stop codon). Building blocks and restriction enzymes for cloning the libraries were chosen, as listed in the table below. The chosen components in each region were mixed at molar ratio of 1:1, and two sets of DNA mixtures were digested with unique restriction enzymes. DNA fragments were separated with 1% agarose gel and purified by Qiagen gel extraction kit. DNA with XTEN insertion in the first desired region was regarded as the insert (the smaller DNA fragment in agarose gel), while DNA with XTEN insertion in the second desired region was regarded as vector (the bigger DNA fragment in agarose gel). The insert and vector were ligated in order to reconstitute the plasmid. The ligated DNA mixture was used to transform DH5a E. coli competent host cells. Transformants were screened by rolling circle amplification (RCA) and Sanger sequencing to cover approximately 3-4 times the potential library size. Unique clones were identified and minipreped. Two distinct restriction digestions were then used to further confirm the integrity of XTEN in each region. The amino acid and the encoding DNA sequences for the resulting CFXTEN fusion proteins are listed in Table 21.

CFXTEN with One or Two XTEN Insertions within the B/a3 Domain and C Terminus:

The B/a3 domain and C-terminus of FVIII are unstructured regions that tolerated XTEN insertions well. The B/a3 domain further mediated interactions with other cofactors, including the von Willibrand Factor. To investigate the optimal XTEN insertions at the B/a3 domain, select deletions and mutations of the region were made via PCR-based mutagenesis methods. Select PCR reactions and the vectors were digested with unique restriction enzymes as listed in Table 18. DNA fragments were separated with 1% agarose gel and purified by Qiagen gel extraction kit. DNA with XTEN insertion in the first desired region was regarded as the insert (the smaller DNA fragment in agarose gel), while DNA with XTEN insertion in the second desired region was regarded as vector (the bigger DNA fragment in agarose gel). The insert and vector were ligated in order to reconstitute the plasmid. The ligated DNA mixture was used to transform DH5α E. coli competent host cells. Transformants were screened by colony PCR and Sanger sequencing to cover approximately 8× the potential library size. Unique clones were identified and minipreped. One three-enzyme restriction digestion was then used to further confirm the integrity of XTEN in each region. The amino acid and the encoding DNA sequences for the resulting CFXTEN fusion proteins are listed in Table 21.

TABLE 18

Cloning design for FVIII libraries with two XTEN insertions

| Library ID | Insert components (XTEN region) | Vector components (XTEN region) | Restriction enzymes |
|---|---|---|---|
| LSD0001 | pSD0005, pSD0006, pSD0007, pSD0008, pSD0017, pSD0018, pBC0136, pBC0137 (B-domain) | pSD0013 (C-termini) | NheI + ClaI |
| LSD0002 | pSD0005, pSD0006, pSD0007, pSD0008, pSD0017, pSD0018, pBC0136, pBC0137 (B-domain) | pSD0014 (C-termini) | NheI + ClaI |

TABLE 18-continued

Cloning design for FVIII libraries with two XTEN insertions

| Library ID | Insert components (XTEN region) | Vector components (XTEN region) | Restriction enzymes |
|---|---|---|---|
| LSD0003 | pSD0005, pSD0006, pSD0007, pSD0008, pSD0017, pSD0018, pBC0136, pBC0137 (B-domain) | pSD0019 (C-termini) | NheI + ClaI |
| LSD0004 | pSD0005, pSD0006, pSD0007, pSD0008, pSD0017, pSD0018, pBC0136, pBC0137 (B-domain) | pSD0020 (C-termini) | NheI + ClaI |
| LSD0005 | pSD0045, pSD0046, pSD0048, pSD0049, pSD0050, pSD0051, pSD0052 (A1-R1) | pSD0001 (A2-R1) | BsiWI + AflII |
| LSD0006 | pSD0045, pSD0046, pSD0048, pSD0049, pSD0050, pSD0051, pSD0052 (A1-R1) | pSD0002 (A2-R1) | BsiWI + AflII |
| LSD0007 | pSD0045, pSD0046, pSD0048, pSD0049, pSD0050, pSD0051, pSD0052 (A1-R1) | pSD0003 (A2-R1) | BsiWI + AflII |
| LSD0008 | pSD0045, pSD0046, pSD0048, pSD0049, pSD0050, pSD0051, pSD0052 (A1-R1) | pSD0004 (A2-R1) | BsiWI + AflII |
| LSD0037 | pSD0045, pSD0046, pSD0049, pSD0050, pSD0051, pSD0052 (A1-R1) | pSD0032 (A2-R1) | BsiWI + AflII |
| LSD0038 | pSD0039 (a3) | pSD0045, pSD0046, pSD0049, pSD0050, pSD0051, pSD0052 (A1-R1) | BamHI + ClaI |
| LSD0039 | pSD0039 (a3) | pSD0032, pSD0001, pSD0003 (A2-R1) | BamHI + ClaI |
| LSD0040 | pSD0040, pSD0010, pSD0041 (A3 -R1) | pSD0045, pSD0046, pSD0049, pSD0050, pSD0051, pSD0052 (A1-R1) | ClaI + XbaI |
| LSD0041 | pSD0040, pSD0010, pSD0041 (A3-R1) | pSD0032, pSD0001, pSD0003 (A2-R1) | ClaI + XbaI |
| LSD0042 | pSD0062, pSD0063, pSD0043, pSD0044 (A3-R2) | pSD0045, pSD0046, pSD0049, pSD0050, pSD0051, pSD0052 (A1-R1) | ClaI + XbaI |
| LSD0043 | pSD0062, pSD0063, pSD0043, pSD0044 (A3-R2) | pSD0032, pSD0001, pSD0003 (A2-R1) | ClaI + XbaI |
| LSD0044 | pSD0062, pSD0063, pSD0043, pSD0044 (A3-R2) | pSD0040, pSD0010, pSD0041 (A3-R1) | PflMI + XbaI |
| LSD0045 | pSD0039 (a3) | pSD0040, pSD0010, pSD0041 (A3-R1) | BamHI + ClaI |
| LSD0046 | pSD0039 (a3) | pSD0062, pSD0063, pSD0043, pSD0044 (A3-R2) | BamHI + ClaI |
| LSD0047 | pSD0046 (A1-R1) | pSD0001, pSD0003 (A2-R1) | BsiWI + AflII |
| LSD0048 | pSD0045, pSD0051 (A1-R1) | pSD0003 (A2-R1) | BsiWI + AflII |
| pNL0006 | PCR product | LSD0003.006 (B Domain and C termini) | BamHI + PflMI |
| pNL0007 | PCR product | LSD0003.006 (B Domain and C termini) | ClaI + PflMI |
| pNL0008 | PCR product | LSD0003.009 (B Domain and C termini) | ClaI + PflMI |
| pNL0009 | PCR product | pSD0039 (a3 Domain) | BamHI + AscI |
| pNL0010 | LSD0003.006 (B Domain and C termini) | pNL0009 (a3 Domain) | XbaI + AgeI |

Example 22: Construction of BDD FVIII Expression Vectors with 3-5 XTEN Insertions at sites 18/26, 403, 745/1656, 1720, 1900 or 2332

FVIII-fusion constructs with XTEN insertions at sites 18/26, 403, 745/1656, 1720, 1900 or 2332 were chosen to recombine and generate constructs with 3, 4, 5 or 6 XTEN insertions.

Construction of BDD FVIII Expression Vectors with 3-5 XTEN Insertions at Sites 26, 403, 1656, 1720, or 1900

The chosen constructs with single XTEN at the desired sites were: pSD0050, pSD0001, pSD0039, pSD0010, and pSD0062. Constructs with double XTENs at the desired sites included LSD0005.002, LSD0038.001, LSD0040.002, LSD0042.013, LSD0039.010, LSD0041.008, LSD0043.008, LSD0045.002, LSD0046.002, and LSD0044.002. Building blocks and restriction enzymes for cloning the constructs were chosen, as listed in Table 19 below. Chosen components were digested with unique restriction enzymes. DNA of inserts and vectors were separated with 1% agarose gel and purified by Qiagen gel extraction kit. The insert and vector were ligated, and then transformed into DH5a E. coli competent host cells. Four colonies for each construct were analyzed by RCA and DNA sequencing. Clones with desired XTEN insertions were minipreped. Restriction digestions were then used to further confirm the integrity of XTEN in each region. The amino acid and the encoding DNA sequences for the resulting CFXTEN fusion proteins are listed in Table 21. The resulting constructs were numbered pSD0077 to pSD0092.

Construction of BDD FVIII Expression Vectors with 4-6 XTEN Insertions at Sites 18, 403, 1656, 1720, 1900 or 2332

Constructs pSD0077 to pSD0092 served as building blocks to generate 4- to 6-XTEN constructs with insertions at 18, 403, 1656, 1720, 1900 and 2332. Building block constructs and restriction enzymes for cloning the constructs were chosen, as listed in Table 19 below. Chosen components were digested with unique restriction enzymes. DNA of inserts and vectors were separated with 1% agarose gel and purified by Qiagen gel extraction kit. The insert and vector were ligated, and then transformed into DH5a E. coli competent host cells. Eight colonies for each construct were analyzed by colony PCR and DNA sequencing. Clones with desired XTEN insertions were minipreped. Restriction digestions were then used to further confirm the integrity of XTEN in each region. The amino acid and the encoding DNA sequences for the resulting CFXTEN fusion proteins are listed in Table 21. The resulting constructs were numbered pBC0258 to pBC0268.

TABLE 19

Cloning design for FVIII libraries with 3-5 XTEN insertions at sites 26, 403, 1656, 1720, or 1900

| Construct Name | Insert components (XTEN region) | Vector components (XTEN region) | Restriction enzymes |
|---|---|---|---|
| pSD0077 | pSD0050 (A1-R1) | LSD0039.010 (A2-R1, a3) | BsiWI + AflII |
| pSD0078 | pSD0010 (A3-R1) | LSD0005.002 (A1-R1, A2-R1) | ClaI + XbaI |
| pSD0079 | pSD0062 (A3-R2) | LSD0005.002 (A1-R1, A2-R1) | ClaI + XbaI |
| pSD0080 | pSD0050 (A1-R1) | LSD0045.002 (a3, A3-R1) | BsiWI + AflII |
| pSD0081 | pSD0050 (A1-R1) | LSD0046.002 (a3, A3-R2) | BsiWI + AflII |
| pSD0082 | pSD0050 (A1-R1) | LSD0044.002 (A3-R1, A3-R2) | BsiWI + AflII |
| pSD0083 | pSD0010 (A3-R1) | LSD0039.010 (A2-R1, a3) | ClaI + XbaI |
| pSD0084 | pSD0062 (A3-R2) | LSD0039.010 (A2-R1, a3) | ClaI + XbaI |
| pSD0085 | pSD0062 (A3-R2) | LSD0041.008 (A2-R1, A3-R1) | PflMI + XbaI |
| pSD0086 | pSD0062 (A3-R2) | LSD0045.002 (a3, A3-R1) | PflMI + XbaI |
| pSD0087 | LSD0039.010 (A2-R1, a3) | LSD0040.002 (A1-R1, A3-R1) | NheI + ClaI |
| pSD0088 | LSD0039.010 (A2-R1, a3) | LSD0042.013 (A1-R1, A3-R2) | NheI + ClaI |
| pSD0089 | LSD0044.002 (A3-R1, A3-R2) | LSD0005.002 (A1-R1, A2-R1) | ClaI + XbaI |
| pSD0090 | LSD0044.002 (A3-R1, A3-R2) | LSD0038.001 (A1-R1, a3) | ClaI + XbaI |
| pSD0091 | LSD0044.002 (A3-R1, A3-R2) | LSD0039.010 (A2-R1, a3) | ClaI + XbaI |
| pSD0092 | LSD0044.002 (A3-R1, A3-R2) | pSD0077 (A1-R1, A2-R1, a3) | ClaI + XbaI |
| pBC0247 | pSD0077 | LSD0050.003 | NheI + BstBI |
| pBC0248 | pSD0078 | LSD0050.003 | NheI + BstBI |
| pBC0249 | pSD0079 | LSD0050.003 | NheI + BstBI |
| pBC0250 | pSD0080 | LSD0050.003 | NheI + BstBI |
| pBC0251 | pSD0082 | LSD0050.003 | NheI + BstBI |
| pBC0252 | pSD0080 | LSD0050.003 | NheI + BstBI |
| pBC0253 | pSD0087 | LSD0050.003 | NheI + BstBI |
| pBC0254 | pSD0088 | LSD0050.003 | NheI + BstBI |
| pBC0255 | pSD0089 | LSD0050.003 | NheI + BstBI |
| pBC0256 | pSD0090 | LSD0050.003 | NheI + BstBI |
| pBC0257 | pSD0092 | LSD0050.003 | NheI + BstBI |
| pNL0022 | LSD0003.009 | pSD0083 | XbaI + AgeI |
| pNL0023 | LSD0003.009 | pSD0084 | XbaI + AgeI |
| pNL0024 | LSD0003.009 | pSD0085 | XbaI + AgeI |
| pNL0025 | LSD0003.009 | pSD0086 | XbaI + AgeI |
| pNL0030 | LSD0003.009 | pSD0091 | XbaI + AgeI |
| pBC0258 | LSD0003.006 | pBC0247 | BamHI + ClaI |
| pBC0259 | LSD0003.006 | pBC0248 | BamHI + ClaI |
| pBC0260 | LSD0003.006 | pBC0249 | BamHI + ClaI |
| pBC0261 | LSD0003.006 | pBC0250 | BamHI + ClaI |
| pBC0262 | LSD0003.006 | pBC0251 | BamHI + ClaI |
| pBC0263 | LSD0003.006 | pBC0252 | BamHI + ClaI |
| pBC0264 | LSD0003.006 | pBC0255 | BamHI + ClaI |
| pBC0265 | LSD0003.006 | pNL0022 | BamHI + ClaI |
| pBC0266 | LSD0003.006 | pNL0023 | BamHI + ClaI |
| pBC0267 | LSD0003.006 | pNL0024 | BamHI + ClaI |
| pBC0268 | LSD0003.006 | pNL0025 | BamHI + ClaI | digestions were then used to further confirm the integrity of XTEN in each region. The amino acid and the encoding DNA sequences for the resulting CFXTEN fusion proteins are listed in Table 21. The resulting constructs were numbered pBC0247 to pBC0257, pNL0022, 23, 24, 25, and 30

Construction of BDD FVIII Expression Vectors with 4-6 XTEN Insertions at Sites 18, 403, 745, 1720, 1900 or 2332

Constructs pBC0247 to pBC0252, pBC0255, pNL0022 to pNL0025 served as building blocks to generate 4- to 6-XTEN constructs with insertions at 18, 403, 745, 1720, 1900 and 2332. Building block constructs and restriction enzymes for cloning the constructs were chosen, as listed in Table 19 below. Chosen components were digested with unique restriction enzymes. DNA of inserts and vectors were separated with 1% agarose gel and purified by Qiagen gel extraction kit. The insert and vector were ligated, and then transformed into DH5a E. coli competent host cells. Eight colonies for each construct were analyzed by colony PCR and DNA sequencing. Clones with desired XTEN insertions were minipreped. Restriction digestions were then used to further confirm the integrity of XTEN in each region. The amino acid and the encoding DNA sequences for the result- Example 23: Construction of CFXTEN Expression Vectors with Three or Four XTENs: The First XTEN in the B Domain, the Second XTEN at the C-Terminus, and the Third or Fourth XTEN Insertion within the A1 or A2 or A3 Domains Libraries of CFXTEN fusion proteins were constructed with three XTEN insertions by combining coagulation-active clones with XTEN insertions in the A1, A2, or A3 domains and clones with XTEN inserted within the B domain and at the C-terminus. Additional libraries were constructed with a fourth XTEN added in the A1, A2, or A3 domains to select members of the 3 XTEN libraries. The design of the cloning scheme is summarized in the table below. DNA was prepared for the inserts and vectors by restriction enzyme digestion and agarose gel purification. After ligating the inserts with the corresponding vectors, the ligated DNA mixture was used to transform DH5a competent E. coli host cells. Transformants were screened by RCA and sequencing to cover approximately 3-4 times the potential library size. Unique clones were identified and mini-prepped. Three distinct restriction digestions were then used to further confirm the integrity of each XTEN. The amino acid and the encoding DNA sequences for the resulting CFXTEN fusion proteins are listed in Table 21.

TABLE 20

Cloning design for FVIII libraries with 3 XTEN insertions at sites B domain, C-termini, and A1/A2/A3 domain

| Library ID | Insert component XTEN region) | Vector components (XTEN region) | Restriction enzymes |
|---|---|---|---|
| LSD0049 | LSD0003.006 (3 domain and C-termini) | pSD0045, pSD0046, pSD0049, pSD0050, pSD0051, pSD0052 (A1-R1) | BamHI + AgeI |
| LSD0050 | LSD0003.009 (B domain and C-termini) | pSD0045, pSD0046, pSD0049, pSD0050, pSD0051, pSD0052 (A1-R1) | BamHI + AgeI |
| LSD0051 | LSD0003.006 (B domain and C-termini) | pSD0032, pSD0001, pSD0003 (A2-R1) | BamHI + AgeI |
| LSD0052 | LSD0003.009 (B domain and C-termini) | pSD0032, pSD0001, pSD0003 (A2-R1) | BamHI + AgeI |
| LSD0053 | pSD0040, pSD0010, pSD0041 (A3-R1) | LSD0003.006 (B domain and C-termini) | ClaI + XbaI |
| LSD0054 | pSD0040, pSD0010, pSD0041 (A3-R1) | LSD0003.009 (B domain and C-termini) | ClaI + XbaI |
| LSD0055 | pSD0062, pSD0063, pSD0043, pSD0044 (A3-R2) | LSD0003.006 (B domain and C-termini) | ClaI + XbaI |
| LSD0056 | pSD0062, pSD0063, pSD0043, pSD0044 (A3-R2) | LSD0003.009 (B domain and C-termini) | ClaI + XbaI |
| LSD0057 | pSD0001 (A2-R1) | LSD0049.021, LSD0049.002, LSD0049.011, LSD0049.012 (A1-R1, B domain and C-termini) | NheI + BamHI |
| LSD0058 | pSD0003 (A2-R1) | LSD0049.021, LSD0049.002, LSD0049.011, LSD0049.012 (A1-R1, B domain and C-termini) | NheI + BamHI |
| LSD0059 | pNL0005 (A2-R1) | LSD0049.021, LSD0049.002, LSD0049.011, LSD0049.012 (A1-R1, B domain and C-termini) | NheI + BamHI |
| LSD0060 | pBC0246 (A2-R1) | LSD0049.021, LSD0049.002, LSD0049.011, LSD0049.012 (A1-R1, B domain and C-termini) | NheI + BamHI |
| LSD0061 | pSD0009 (A3-R1) | LSD0049.021, LSD0049.002, LSD0049.011, LSD0049.012 (A1-R1, B domain and C-termini) | ClaI + XbaI |
| LSD0062 | pSD0010 (A3-R1) | LSD0049.021, LSD0049.002, LSD0049.011, LSD0049.012 (A1-R1, B domain and C-termini) | ClaI + XbaI |
| LSD0063 | pNL0004 (A3-R2) | LSD0049.021, LSD0049.002, LSD0049.011, LSD0049.012 (A1-R1, B domain and C-termini) | ClaI + XbaI |
| LSD0064 | pSD0063 (A3-R2) | LSD0049.021, LSD0049.002, LSD0049.011, LSD0049.012 (A1-R1, B domain and C-termini) | ClaI + XbaI |
| LSD0065 | pNL0002 (A3-R2) | LSD0049.021, LSD0049.002, LSD0049.011, LSD0049.012 (A1-R1, B domain and C-termini) | ClaI + XbaI |
| LSD0066 | pSD0043 (A3-R2) | LSD0049.021, LSD0049.002, LSD0049.011, LSD0049.012 (A1-R1, B domain and C-termini) | ClaI + XbaI |
| LSD0067 | pNL0003 (A3-R2) | LSD0049.021, LSD0049.002, LSD0049.011, LSD0049.012 (A1-R1, B domain and C-termini) | ClaI + XbaI |
| LSD0068 | pSD0044 (A3-R2) | LSD0049.021, LSD0049.002, LSD0049.011, LSD0049.012 (A1-R1, B domain and C-termini) | ClaI + XbaI |
| LSD0069 | pSD0009 (A3-R1) | LSD0051.002, pBC0244, pBC0245 (A2-R1, B domain and C-termini) | ClaI + XbaI |
| LSD0070 | pSD0010 (A3-R1) | LSD0051.002, pBC0244, pBC0245 (A2-R1, B domain and C-termini) | ClaI + XbaI |
| LSD0071 | pNL0004 (A3-R2) | LSD0051.002, pBC0244, pBC0245 (A2-R1, B domain and C-termini) | ClaI + XbaI |
| LSD0072 | pSD0063 (A3-R2) | LSD0051.002, pBC0244, pBC0245 (A2-R1, B domain and C-termini) | ClaI + XbaI |
| LSD0073 | pNL0002 (A3-R2) | LSD0051.002, pBC0244, pBC0245 (A2-R1, B domain and C-termini) | ClaI + XbaI |
| LSD0074 | pSD0043 (A3-R2) | LSD0051.002, pBC0244, pBC0245 (A2-R1, B domain and C-termini) | ClaI + XbaI |
| LSD0075 | pNL0003 (A3-R2) | LSD0051.002, pBC0244, pBC0245 (A2-R1, B domain and C-termini) | ClaI + XbaI |
| LSD0076 | pSD0044 (A3-R2) | LSD0051.002, pBC0244, pBC0245 (A2-R1, B domain and C-termini) | ClaI + XbaI |
| pSD0093 | pNL0004 (A3-R2) | LSD0053.022 (A3-R1, B domain and C-termini) | PflMI + XbaI |
| pSD0094 | pSD0063 (A3-R2) | LSD0053.022 (A3-R1, B domain and C-termini) | PflMI + XbaI |
| pSD0095 | pNL0002 (A3-R2) | LSD0053.022 (A3-R1, B domain and C-termini) | PflMI + XbaI |
| pSD0096 | pSD0043 (A3-R2) | LSD0053.022 (A3-R1, B domain and C-termini) | PflMI + XbaI |

TABLE 20-continued

Cloning design for FVIII libraries with 3 XTEN insertions at sites B domain, C-termini, and A1/A2/A3 domain

| Library ID | Insert component XTEN region) | Vector components (XTEN region) | Restriction enzymes |
|---|---|---|---|
| pSD0097 | pNL0003 (A3-R2) | LSD0053.022 (A3-R1, B domain and C-termini) | PflMI + XbaI |
| pSD0098 | pSD0044 (A3-R2) | LSD0053.022 (A3-R1, B domain and C-termini) | PflMI + XbaI |
| pCS0001 | pBC0168 (A1) | LSD0055.021 (A3-R1, B domain and C-termini) | BsiWI + BamHI |
| pCS0002 | pBC0134 (A2_R2) | LSD0055.021 (A3-R1, B domain and C-termini) | BsiWI + BamHI |
| pCS0003 | pBC0179 (C1) | LSD0055.021 (A3-R1, B domain and C-termini) | ApaI + XbaI |
| pCS0004 | pBC0143 (C1) | LSD0055.021 (A3-R1, B domain and C-termini) | ApaI + XbaI |
| pCS0005 | pBC0182 (C2) | LSD0055.021 (A3-R1, B domain and C-termini) | ApaI + XbaI |
| pCS0006 | pBC0144 (C2) | LSD0055.021 (A3-R1, B domain and C-termini) | ApaI + XbaI |
| pBC0269 | pBC0165 (A1_R1) | LSD0003.006 (B domain and C-termini) | BsiWI + BamHI |
| pBC0270 | pBC0132 (A2_R1) | LSD0003.006 (B domain and C-termini) | BsiWI + BamHI |
| pBC0271 | pBC0138 (A3_R1) | LSD0003.006 (B domain and C-termini) | ClaI + XbaI |
| pBC0272 | pBC0176 (A3_R2) | LSD0003.006 (B domain and C-termini) | ClaI + XbaI |
| pBC0273 | pSD0001 (A2_R1) | LSD0003.006 (B domain and C-termini) | BsiWI + BamHI |
| pBC0274 | pSD0009 (A3_R1) | LSD0003.006 (B domain and C-termini) | ClaI + XbaI |
| pBC0275 | pNL0004 (A3_R2) | LSD0003.006 (B domain and C-termini) | ClaI + XbaI |
| pBC0276 | pBC0280 (A1_R1) | LSD0003.006 (B domain and C-termini) | BsiWI + BamHI |
| pBC0277 | pBC0281 (A2_R1) | LSD0003.006 (B domain and C-termini) | BsiWI + BamHI |
| pBC0278 | pBC0282 (A3_R1) | LSD0003.006 (B domain and C-termini) | ClaI + XbaI |
| pBC0279 | pBC0283 (A3_R2) | LSD0003.006 (B domain and C-termini) | ClaI + XbaI |
| L09_01 | pBC0284 (CT) | pBC0285, 286, 287, 288, 289, 290, 291, 292, 293 (B domain and A3_R2) | XbaI + AgeI |
| L09_01 | pSD0014 (CT) | pBC0285, 286, 287, 288, 289, 290, 291, 292, 293 (B domain and A3_R2) | XbaI + AgeI |
| L09_01 | pSD0020 (CT) | pBC0285, 286, 287, 288, 289, 290, 291, 292, 293 (B domain and A3_R2) | XbaI + AgeI |

TABLE 21

DNA and Amino Acid Sequences of FVIII-XTEN Constructs

| Construct Name | Amino acid sequence disclosed as SEQ ID NO: | DNA sequence disclosed as SEQ ID NO: |
|---|---|---|
| pBC0114 | 595 | 596 |
| pBC0126 | 597 | 598 |
| pBC0127 | 599 | 600 |
| pBC0165 | 601 | 602 |
| pBC0183 | 603 | 604 |
| pBC0184 | 605 | 606 |
| pBC0166 | 607 | 608 |
| pBC0185 | 609 | 610 |
| pBC0167 | 611 | 612 |
| pBC0128 | 613 | 614 |
| pBC0168 | 615 | 616 |
| pBC0129 | 617 | 618 |
| pBC0169 | 619 | 620 |
| pBC0130 | 621 | 622 |
| pBC0131 | 623 | 624 |
| pBC0132 | 625 | 626 |
| pBC0170 | 627 | 628 |
| pBC0133 | 629 | 630 |
| pBC0171 | 631 | 632 |
| pBC0134 | 633 | 634 |
| pBC0172 | 635 | 636 |
| pBC0135 | 637 | 638 |
| pBC0149 | 639 | 640 |
| pBC0136 | 641 | 642 |
| pBC0137 | 643 | 644 |
| pBC0138 | 645 | 646 |
| pBC0139 | 647 | 648 |
| pBC0140 | 649 | 650 |
| pBC0173 | 651 | 652 |
| pBC0174 | 653 | 654 |
| pBC0175 | 655 | 656 |
| pBC0176 | 657 | 658 |
| pBC0177 | 659 | 660 |
| pBC0178 | 661 | 662 |
| pBC0141 | 663 | 664 |
| pBC0179 | 665 | 666 |
| pBC0180 | 667 | 668 |
| pBC0142 | 669 | 670 |
| pBC0143 | 671 | 672 |
| pBC0181 | 673 | 674 |
| pBC0182 | 675 | 676 |
| pBC0144 | 677 | 678 |
| pBC0145 | 679 | 680 |
| pBC0146 | 681 | 682 |
| pSD0001 | 683 | 684 |
| pSD0002 | 685 | 686 |
| pSD0003 | 687 | 688 |
| pSD0004 | 689 | 690 |
| pSD0005 | 691 | 692 |
| pSD0006 | 693 | 694 |
| pSD0007 | 695 | 696 |
| pSD0008 | 697 | 698 |
| pSD0009 | 699 | 700 |
| pSD0010 | 701 | 702 |
| pSD0011 | 703 | 704 |
| pSD0012 | 705 | 706 |
| pSD0013 | 707 | 708 |
| pSD0014 | 709 | 710 |
| pSD0017 | 711 | 712 |
| pSD0018 | 713 | 714 |
| pSD0019 | 715 | 716 |
| pSD0020 | 717 | 718 |
| pSD0015 | 719 | 720 |
| pSD0016 | 721 | 722 |
| pSD0021 | 723 | 724 |
| pSD0022 | 725 | 726 |
| pSD0023 | 727 | 728 |
| pSD0024 | 729 | 730 |
| pSD0025 | 731 | 732 |
| pSD0026 | 733 | 734 |
| pSD0027 | 735 | 736 |
| pSD0028 | 737 | 738 |
| pSD0029 | 739 | 740 |
| pSD0030 | 741 | 742 |
| pSD0031 | 743 | 744 |
| pSD0032 | 745 | 746 |

TABLE 21-continued

DNA and Amino Acid Sequences of FVIII-XTEN Constructs

| Construct Name | Amino acid sequence disclosed as SEQ ID NO: | DNA sequence disclosed as SEQ ID NO: |
|---|---|---|
| pSD0033 | 747 | 748 |
| pSD0034 | 749 | 750 |
| pSD0035 | 751 | 752 |
| pSD0036 | 753 | 754 |
| pSD0037 | 755 | 756 |
| pSD0038 | 757 | 758 |
| pSD0039 | 759 | 760 |
| pSD0040 | 761 | 762 |
| pSD0041 | 763 | 764 |
| pSD0042 | 765 | 766 |
| pSD0043 | 767 | 768 |
| pSD0044 | 769 | 770 |
| pSD0062 | 771 | 772 |
| pSD0063 | 773 | 774 |
| pSD0045 | 775 | 776 |
| pSD0046 | 777 | 778 |
| pSD0047 | 779 | 780 |
| pSD0048 | 781 | 782 |
| pSD0049 | 783 | 784 |
| pSD0050 | 785 | 786 |
| pSD0051 | 787 | 788 |
| pSD0052 | 789 | 790 |
| pSD0053 | 791 | 792 |
| pSD0054 | 793 | 794 |
| pSD0055 | 795 | 796 |
| pSD0056 | 797 | 798 |
| pSD0057 | 799 | 800 |
| pSD0058 | 801 | 802 |
| pSD0059 | 803 | 804 |
| pSD0060 | 805 | 806 |
| pSD0061 | 807 | 808 |
| LSD0001.002 | 809 | 810 |
| LSD0001.005 | 811 | 812 |
| LSD0001.006 | 813 | 814 |
| LSD0001.011 | 815 | 816 |
| LSD0001.012 | 817 | 818 |
| LSD0001.013 | 819 | 820 |
| LSD0001.016 | 821 | 822 |
| LSD0001.021 | 823 | 824 |
| LSD0002.001 | 825 | 826 |
| LSD0002.002 | 827 | 828 |
| LSD0002.014 | 829 | 830 |
| LSD0003.004 | 831 | 832 |
| LSD0003.006 | 833 | 834 |
| LSD0003.009 | 835 | 836 |
| LSD0003.014 | 837 | 838 |
| LSD0004.010 | 839 | 840 |
| LSD0004.011 | 841 | 842 |
| LSD0004.014 | 843 | 844 |
| LSD0004.016 | 845 | 846 |
| LSD0004.022 | 847 | 848 |
| LSD0003.016 | 849 | 850 |
| LSD0005.002 | 851 | 852 |
| LSD0005.004 | 853 | 854 |
| LSD0005.005 | 855 | 856 |
| LSD0005.011 | 857 | 858 |
| LSD0005.018 | 859 | 860 |
| LSD0006.002 | 861 | 862 |
| LSD0006.005 | 863 | 864 |
| LSD0006.007 | 865 | 866 |
| LSD0006.011 | 867 | 868 |
| LSD0007.002 | 869 | 870 |
| LSD0007.004 | 871 | 872 |
| LSD0007.013 | 873 | 874 |
| LSD0008.001 | 875 | 876 |
| LSD0008.002 | 877 | 878 |
| LSD0008.006 | 879 | 880 |
| LSD0008.009 | 881 | 882 |
| LSD0008.017 | 883 | 884 |
| LSD0002.025 | 885 | 886 |
| LSD0002.013 | 887 | 888 |
| LSD0003.025 | 889 | 890 |
| LSD0004.025 | 891 | 892 |
| LSD0003.005 | 893 | 894 |
| LSD0007.008 | 895 | 896 |
| LSD0044.002 | 897 | 898 |
| LSD0044.005 | 899 | 900 |
| LSD0044.039 | 901 | 902 |
| LSD0044.022 | 903 | 904 |
| LSD0044.003 | 905 | 906 |
| LSD0044.001 | 907 | 908 |
| LSD0038.001 | 909 | 910 |
| LSD0038.003 | 911 | 912 |
| LSD0038.008 | 913 | 914 |
| LSD0038.012 | 915 | 916 |
| LSD0038.013 | 917 | 918 |
| LSD0038.015 | 919 | 920 |
| LSD0039.001 | 921 | 922 |
| LSD0039.003 | 923 | 924 |
| LSD0039.010 | 925 | 926 |
| LSD0045.001 | 927 | 928 |
| LSD0045.002 | 929 | 930 |
| LSD0042.014 | 931 | 932 |
| LSD0042.023 | 933 | 934 |
| LSD0042.006 | 935 | 936 |
| LSD0042.013 | 937 | 938 |
| LSD0042.001 | 939 | 940 |
| LSD0042.039 | 941 | 942 |
| LSD0042.047 | 943 | 944 |
| LSD0042.003 | 945 | 946 |
| LSD0042.004 | 947 | 948 |
| LSD0042.008 | 949 | 950 |
| LSD0042.038 | 951 | 952 |
| LSD0042.082 | 953 | 954 |
| LSD0042.040 | 955 | 956 |
| LSD0037.002 | 957 | 958 |
| LSD0037.009 | 959 | 960 |
| LSD0037.011 | 961 | 962 |
| LSD0047.002 | 963 | 964 |
| LSD0047.005 | 965 | 966 |
| LSD0048.007 | 967 | 968 |
| LSD0046.001 | 969 | 970 |
| LSD0046.002 | 971 | 972 |
| LSD0046.003 | 973 | 974 |
| LSD0040.011 | 975 | 976 |
| LSD0040.042 | 977 | 978 |
| LSD0040.002 | 979 | 980 |
| LSD0040.008 | 981 | 982 |
| LSD0040.021 | 983 | 984 |
| LSD0040.037 | 985 | 986 |
| LSD0040.046 | 987 | 988 |
| LSD0040.003 | 989 | 990 |
| LSD0040.006 | 991 | 992 |
| LSD0040.007 | 993 | 994 |
| L5D0040.010 | 995 | 996 |
| LSD0040.039 | 997 | 998 |
| LSD0040.052 | 999 | 1000 |
| LSD0041.001 | 1001 | 1002 |
| LSD0041.004 | 1003 | 1004 |
| LSD0041.006 | 1005 | 1006 |
| LSD0041.008 | 1007 | 1008 |
| LSD0041.010 | 1009 | 1010 |
| LSD0041.014 | 1011 | 1012 |
| LSD0041.016 | 1013 | 1014 |
| LSD0041.035 | 1015 | 1016 |
| LSD0043.001 | 1017 | 1018 |
| LSD0043.002 | 1019 | 1020 |
| LSD0043.005 | 1021 | 1022 |
| LSD0043.006 | 1023 | 1024 |
| LSD0043.007 | 1025 | 1026 |
| LSD0043.008 | 1027 | 1028 |
| LSD0043.015 | 1029 | 1030 |
| LSD0043.029 | 1031 | 1032 |
| LSD0043.043 | 1033 | 1034 |
| pSD0077 | 1035 | 1036 |
| pSD0078 | 1037 | 1038 |
| pSD0079 | 1039 | 1040 |
| pSD0080 | 1041 | 1042 |
| pSD0081 | 1043 | 1044 |
| pSD0082 | 1045 | 1046 |

TABLE 21-continued

DNA and Amino Acid Sequences of FVIII-XTEN Constructs

| Construct Name | Amino acid sequence disclosed as SEQ ID NO: | DNA sequence disclosed as SEQ ID NO: |
|---|---|---|
| pSD0083 | 1047 | 1048 |
| pSD0084 | 1049 | 1050 |
| pSD0085 | 1051 | 1052 |
| pSD0086 | 1053 | 1054 |
| pSD0087 | 1055 | 1056 |
| pSD0088 | 1057 | 1058 |
| pSD0089 | 1059 | 1060 |
| pSD0090 | 1061 | 1062 |
| pSD0091 | 1063 | 1064 |
| pSD0092 | 1065 | 1066 |
| LSD0049.002 | 1067 | 1068 |
| LSD0049.008 | 1069 | 1070 |
| LSD0049.011 | 1071 | 1072 |
| LSD0049.012 | 1073 | 1074 |
| LSD0049.020 | 1075 | 1076 |
| LSD0049.021 | 1077 | 1078 |
| LSD0050.002 | 1079 | 1080 |
| LSD0050.003 | 1081 | 1082 |
| LSD0050.007 | 1083 | 1084 |
| LSD0050.010 | 1085 | 1086 |
| LSD0050.012 | 1087 | 1088 |
| LSD0050.014 | 1089 | 1090 |
| LSD0051.002 | 1091 | 1092 |
| LSD0051.003 | 1093 | 1094 |
| LSD0052.001 | 1095 | 1096 |
| LSD0052.003 | 1097 | 1098 |
| LSD0053.021 | 1099 | 1100 |
| LSD0053.022 | 1101 | 1102 |
| LSD0053.024 | 1103 | 1104 |
| LSD0054.021 | 1105 | 1106 |
| LSD0054.025 | 1107 | 1108 |
| LSD0054.026 | 1109 | 1110 |
| LSD0055.021 | 1111 | 1112 |
| LSD0055.022 | 1113 | 1114 |
| LSD0055.026 | 1115 | 1116 |
| LSD0056.021 | 1117 | 1118 |
| LSD0056.024 | 1119 | 1120 |
| LSD0056.025 | 1121 | 1122 |
| pNL0001 | 1123 | 1124 |
| pNL0002 | 1125 | 1126 |
| pNL0003 | 1127 | 1128 |
| pNL0004 | 1129 | 1130 |
| pNL0005 | 1131 | 1132 |
| pNL0006 | 1133 | 1134 |
| pNL0007 | 1135 | 1136 |
| pNL0008 | 1137 | 1138 |
| pNL0009 | 1139 | 1140 |
| pNL0010 | 1141 | 1142 |
| pBC0244 | 1143 | 1144 |
| pBC0245 | 1145 | 1146 |
| pBC0246 | 1147 | 1148 |
| pBC0247 | 1149 | 1150 |
| pBC0248 | 1151 | 1152 |
| pBC0249 | 1153 | 1154 |
| pBC0250 | 1155 | 1156 |
| pBC0251 | 1157 | 1158 |
| pBC0252 | 1159 | 1160 |
| pBC0253 | 1161 | 1162 |
| pBC0254 | 1163 | 1164 |
| pBC0255 | 1165 | 1166 |
| pBC0256 | 1167 | 1168 |
| pBC0257 | 1169 | 1170 |
| pBC0259 | 1171 | 1172 |
| pBC0260 | 1173 | 1174 |
| pBC0262 | 1175 | 1176 |
| pBC0263 | 1177 | 1178 |
| pBC0264 | 1179 | 1180 |
| pBC0266 | 1181 | 1182 |
| pBC0267 | 1183 | 1184 |
| pBC0268 | 1185 | 1186 |
| pNL0016 | 1187 | 1188 |
| pNL0017 | 1189 | 1190 |
| pNL0018 | 1191 | 1192 |
| pNL0022 | 1193 | 1194 |
| pNL0023 | 1195 | 1196 |
| pNL0024 | 1197 | 1198 |
| pNL0025 | 1199 | 1200 |
| pNL0030 | 1201 | 1202 |
| LSD0057.001 | 1203 | 1204 |
| LSD0057.004 | 1205 | 1206 |
| LSD0057.005 | 1207 | 1208 |
| LSD0057.010 | 1209 | 1210 |
| L5D0058.003 | 1211 | 1212 |
| LSD0058.005 | 1213 | 1214 |
| LSD0058.006 | 1215 | 1216 |
| LSD0059.002 | 1217 | 1218 |
| LSD0059.003 | 1219 | 1220 |
| LSD0059.005 | 1221 | 1222 |
| LSD0059.006 | 1223 | 1224 |
| LSD0060.001 | 1225 | 1226 |
| LSD0060.003 | 1227 | 1228 |
| LSD0060.004 | 1229 | 1230 |
| LSD0061.002 | 1231 | 1232 |
| LSD0061.007 | 1233 | 1234 |
| LSD0061.008 | 1235 | 1236 |
| LSD0061.012 | 1237 | 1238 |
| LSD0062.001 | 1239 | 1240 |
| LSD0062.002 | 1241 | 1242 |
| LSD0062.006 | 1243 | 1244 |
| LSD0062.007 | 1245 | 1246 |
| LSD0063.001 | 1247 | 1248 |
| LSD0063.003 | 1249 | 1250 |
| LSD0063.011 | 1251 | 1252 |
| LSD0064.017 | 1253 | 1254 |
| LSD0064.018 | 1255 | 1256 |
| LSD0064.020 | 1257 | 1258 |
| LSD0064.021 | 1259 | 1260 |
| LSD0065.001 | 1261 | 1262 |
| LSD0065.007 | 1263 | 1264 |
| LSD0065.014 | 1265 | 1266 |
| LSD0066.001 | 1267 | 1268 |
| LSD0066.002 | 1269 | 1270 |
| LSD0066.009 | 1271 | 1272 |
| LSD0066.011 | 1273 | 1274 |
| LSD0067.004 | 1275 | 1276 |
| LSD0067.005 | 1277 | 1278 |
| LSD0067.006 | 1279 | 1280 |
| LSD0067.008 | 1281 | 1282 |
| LSD0068.001 | 1283 | 1284 |
| LSD0068.002 | 1285 | 1286 |
| LSD0068.005 | 1287 | 1288 |
| LSD0068.010 | 1289 | 1290 |
| LSD0069.004 | 1291 | 1292 |
| LSD0069.008 | 1293 | 1294 |
| LSD0070.003 | 1295 | 1296 |
| LSD0070.004 | 1297 | 1298 |
| LSD0070.005 | 1299 | 1300 |
| LSD0071.001 | 1301 | 1302 |
| LSD0071.002 | 1303 | 1304 |
| LSD0071.008 | 1305 | 1306 |
| LSD0072.001 | 1307 | 1308 |
| LSD0072.002 | 1309 | 1310 |
| LSD0072.003 | 1311 | 1312 |
| LSD0073.002 | 1313 | 1314 |
| LSD0073.004 | 1315 | 1316 |
| LSD0073.006 | 1317 | 1318 |
| LSD0074.007 | 1319 | 1320 |
| LSD0074.010 | 1321 | 1322 |
| LSD0074.011 | 1323 | 1324 |
| LSD0075.003 | 1325 | 1326 |
| LSD0075.004 | 1327 | 1328 |
| LSD0075.007 | 1329 | 1330 |
| LSD0076.002 | 1331 | 1332 |
| LSD0076.003 | 1333 | 1334 |
| pSD0093 | 1335 | 1336 |
| pSD0094 | 1337 | 1338 |
| pSD0095 | 1339 | 1340 |
| pSD0096 | 1341 | 1342 |
| pSD0097 | 1343 | 1344 |
| pSD0098 | 1345 | 1346 |

TABLE 21-continued

DNA and Amino Acid Sequences of FVIII-XTEN Constructs

| Construct Name | Amino acid sequence disclosed as SEQ ID NO: | DNA sequence disclosed as SEQ ID NO: |
|---|---|---|
| pSD0099 | 1347 | 1348 |
| pSD0100 | 1349 | 1350 |
| pSD0101 | 1351 | 1352 |
| pSD0102 | 1353 | 1354 |
| pSD0103 | 1355 | 1356 |
| pSD0104 | 1357 | 1358 |
| pCS0001 | 1359 | 1360 |
| pCS0002 | 1361 | 1362 |
| pCS0003 | 1363 | 1364 |
| pCS0004 | 1365 | 1366 |
| pCS0005 | 1367 | 1368 |
| pCS0006 | 1369 | 1370 |
| pBC0269 | 1371 | 1372 |
| pBC0270 | 1373 | 1374 |
| pBC0271 | 1375 | 1376 |
| pBC0272 | 1377 | 1378 |
| pBC0273 | 1379 | 1380 |
| pBC0274 | 1381 | 1382 |
| pBC0275 | 1383 | 1384 |
| pBC0276 | 1385 | 1386 |
| pBC0277 | 1387 | 1388 |
| pBC0278 | 1389 | 1390 |
| pBC0279 | 1391 | 1392 |
| pBC0280 | 1393 | 1394 |
| pBC0281 | 1395 | 1396 |
| pBC0282 | 1397 | 1398 |
| pBC0283 | 1399 | 1400 |
| pBC0284 | 1401 | 1402 |
| pBC0285 | 1403 | 1404 |
| pBC0286 | 1405 | 1406 |
| pBC0287 | 1407 | 1408 |
| pBC0288 | 1409 | 1410 |
| pBC0289 | 1411 | 1412 |
| pBC0290 | 1413 | 1414 |
| pBC0291 | 1415 | 1416 |
| pBC0292 | 1417 | 1418 |
| pBC0293 | 1419 | 1420 |
| pBC0294 | 1421 | 1422 |
| pBC0295 | 1423 | 1424 |
| pBC0296 | 1425 | 1426 |
| pBC0297 | 1427 | 1428 |
| pBC0298 | 1429 | 1430 |
| pBC0299 | 1431 | 1432 |
| pBC0300 | 1433 | 1434 |
| pBC0301 | 1435 | 1436 |
| pBC0302 | 1437 | 1438 |
| pBC0303 | 1439 | 1440 |
| pBC0304 | 1441 | 1442 |
| pBC0305 | 1443 | 1444 |
| pBC0306 | 1445 | 1446 |
| pBC0307 | 1447 | 1448 |
| pBC0308 | 1449 | 1450 |
| pBC0309 | 1451 | 1452 |
| pBC0310 | 1453 | 1454 |
| pBC0311 | 1455 | 1456 |
| pBC0312 | 1457 | 1458 |
| pBC0313 | 1459 | 1460 |
| pBC0314 | 1461 | 1462 |
| pBC0315 | 1463 | 1464 |
| pBC0316 | 1465 | 1466 |
| pBC0317 | 1467 | 1468 |
| pBC0318 | 1469 | 1470 |
| pBC0319 | 1471 | 1472 |
| pBC0320 | 1473 | 1474 |
| pBC0321 | 1475 | 1476 |
| PBC0322 | 1477 | 1478 |
| PBC0323 | 1479 | 1480 |
| pNL0040 | 1481 | 1482 |
| pNL0041 | 1483 | 1484 |
| pNL0042 | 1485 | 1486 |
| pNL0043 | 1487 | 1488 |

Example 24: Transfection of Mammalian Cells, Expression of FVIII-XTEN and Assessment of FVIII Activity Mammalian cells, including but not limited to CHO, BHK, COS, and HEK293, are suitable for transformation with the vectors of the Examples, above, in order to express and recover FVIII-XTEN fusion protein. The following are details for methods used to express BDD FVIII and FVIII-XTEN fusion protein constructs pBC0114, pBC0135, pBC0136, pBC0137, pBC0145, pBC0146, and pBC0149 by transient transfection, which includes electroporation and chemical (PEI) transfection methods.

Adherent HEK293 cells purchased from ATCC were revived in medium of vendor's recommendation and passaged for a few generations before multiple vials were frozen in the medium with 5% DMSO. One vial was revived and passaged one more time before transfection. The HEK293 cells were plated 1-2 days before transfection at a density of approximately $7 \times 10^5$ per ml in one T175 per transfection, using 35 ml medium. On the day of transfection the cells were trypsinized, detached and counted, then rinsed in the medium until an even cell suspension was achieved. The cells were counted and an appropriate volume of cells (based on cell count above) were transferred to 50 mL centrifuge tube, such that there were approximately $4 \times 10^6$ cells per transfection. Cells were centrifuged for 5 min at 500 RCF, the supernatant discarded, and the cells resuspended in 10 ml of D-PBS.

Electroporation:

For electroporation, an appropriate volume of resuspension buffer was added using a micropipette (supplied in the Neon™ Transfection System 100 μL Kit), such that 110 μl of buffer was available per transfection. Separate volumes of 110 μl of cell suspension were added to each Eppendorf tube containing 11 μl of plasmid DNA for each of the individual FVIII-XTEN constructs for a total of 6 μg (volume of DNA may be less, qs to 11 μl with sterile $H_2O$). A Neon™ Transfection Device was used for transfection. The program was set to electroporate at 1100 v for a pulse width of 20 ms, for a total of two pulses. A Neon™ Tube (supplied in the Neon™ Transfection System 100 μL Kit) was placed into Neon™ Pipette Station. A volume of 3 mL of Electrolytic Buffer E2 (supplied in the Neon™ Transfection System 100 μL Kit) was added to the Neon™ Tube. Neon™ Pipettes and 1001 Neon™ Tips were used to electroporate 100 μl of cell-plasmid DNA mixture using the Neon™ Pipette Station. The electroporation was executed and when complete, the Neon™ Pipette was removed from the Station and the pipette with the transfected cells was used to transfer the cells, with a circular motion, into a 100 mm×20 mm petri plate containing 10 ml of Opti-MEM I Reduced-Serum Medium (1×, Invitrogen), such that transfected cells were evenly distributed on plate. The cells for each transfection were incubated at 37° C. for expression. On day 3 post-transfection, a 10% volume of salt solution of 10 mM Hepes, 5 mM $CaCl_2$, and 4M NaCl was added to each cell culture and gently mixed for 30 minutes. Each cell culture was transferred to a 50 ml conical centrifuge tube and was centrifuged at 3000 rpm for 10 minutes at 4° C. The supernatants for each culture were placed into a new 50 ml conical tube and then split into aliquots of 5×1 ml in Eppendorf and 2×15 ml conical tubes for assay or were flash frozen before testing for expression of FVIII-XTEN in ELISA and performance in an FVIII activity assay, as described herein.

Chemical Transfection:

Chemical transfection can be accomplished using standard methods known in the art. In the present Example, PEI is utilized, as described.

Suspension 293 Cells are seeded the day before transfection at $7 \times 10^5$ cells/mL in sufficient Freestyle 293 (Invitrogen) medium to provide at least 30 ml working volume, and incubated at 37° C. On the day of transfection, an aliquot of 1.5 ml of the transfection medium is held at room temperature, to which 90 μL of 1 mg/ml PEI is added and vortexed briefly. A volume of 301 of DNA encoding the FVIII-XTEN_AE288 construct (concentration of 1 mg/ml) is added to the PEI solution, which is vortexed for 30 sec. The mixture is held at room temperature for 5-15 min. The DNA/PEI mixture is added to the HEK293 cells and the suspension is incubated at 37° C. using pre-established shake flask conditions. About four hours after the addition of the DNA/PEI mix, a 1× volume of expansion media is added and the cells incubated at 37° C. for 5 days. On the day of harvest, a 10% volume of salt solution of 10 mM Hepes, 5 mM $CaCl_2$, and 4M NaCl is added to the cell culture and gently mixed for 30 minutes. The cell culture is transferred to a 50 ml conical centrifuge tube and is centrifuged at 4000 rpm for 10 minutes at 4° C. The supernatant is placed into a new 50 ml conical tube and then split into aliquots of 5×1 ml in Eppendorf and 2×15 ml conical tubes for assay or are flash frozen before testing for expression of FVIII-XTEN in ELISA and/or performance in an FVIII activity assay, as described herein.

Generation of Stable Pools and Cell Lines that Produce FVIII-XTEN

Stable pools are generated by culturing transfected cells for 3-5 weeks in medium containing selection antibiotics such as puromycin, with medium change every 2-3 days. Stable cells can be used for either production or generation of stable clones. For stable cell line selection during primary screening, cells from stable pools either from on-going passaging or revived from frozen vials are seeded in 96-well plates at a target density of 0.5 cell/well. About 1 week after seeding spent medium from wells with single cell cluster as observed under microscope are tested for expression of FVIII by activity assay or antigen measurement.

For additional rounds of screening, normalized numbers of cells are seeded in multi-well plates. Spent medium is harvested and tested for FVIII concentration by ELISA and FVIII activity assay. Cells would also be harvested from the plates and counted using Vi-Cell. Clones are ranked by (1) FVIII titers according to ELISA and activity; (2) ratios of ELISA titer/cell count and activity titer/cell count; and (3) integrity and homogeneity of products produced by the clones as measured by Western blots. A number of clones for each of the constructs are selected from the primary screening for additional rounds of screening.

For the second round of screening, cells in 96-well plates for the top clones selected from primary screening are first expanded in T25 flasks and then seeded in duplicate 24-well plates. Spent medium is collected from the plates for FVIII activity and antigen quantification and cells harvested and counted by Vi-Cell. Clones are ranked and then selected according to titers by ELISA and activity assay, ELISA titer/cell and activity titer/cell count ratios. Frozen vials are prepared for at least 5-10 clones and again these clones were screened and ranked according to titers by ELISA and activity, and ratios of ELISA titer/cell count and activity titer/cell count, and product integrity and homogeneity by Western blot, and 2-3 clones are selected for productivity evaluation in shake flasks. Final clones are selected based on specific productivity and product quality.

Production of FVIII-XTEN Secreted in Cell Culture Medium by Suspension 293 Stable Clones HEK293 stable cell clones selected by the foregoing methods are seeded in shake flasks at $1-2 \times 10^5$ cells/ml in expression medium. Cell count, cell viability, FVIII activity and antigen expression titers are monitored daily. On the day when FVIII activity and antigen titers and product quality are optimal, the culture is harvested by either centrifugation/sterile filtration or depth filtration/sterile filtration. The filtrate is either used immediately for tangential flow filtration (TFF) processing and purification or stored in −80° C. freezer for TFF processing and purification later.

Example 25: Purification and Characterization of CFXTEN Constructs

Exemplary methods for the purification and characterization of CFXTEN constructs with one or more XTEN follow.

Purification of FVII-XTEN AE864 by FVIII Affinity Chromatography

CFXTEN containing supernatant is filtered using a Cuno ZetaPlus Biocap filter and a Cuno BioAssure capsule and subsequently concentrated by tangential flow filtration using a Millipore Pellicon 2 Mini cartridge with a 30,000 Da MWCO. Using the same tangential flow filtration cartridge the sample is diafiltered into 10 mM histidine, 20 mM calcium chloride, 300 mM sodium chloride, and 0.02% Tween 80 at pH 7.0. FVIIISelect resin (GE 17-5450-01) selectively binds FVIII or B domain deleted FVIII using a 13 kDa recombinant protein ligand coupled to a chromatography resin. The resin is equilibrated with 10 mM histidine, 20 mM calcium chloride, 300 mM sodium chloride, and 0.02% Tween 80 at pH 7.0 and the supernatant loaded. The column is washed with 20 mM histidine, 20 mM calcium chloride, 300 mM sodium chloride, and 0.02% Tween 80 at pH 7.0, then is washed with 20 mM histidine, 20 mM calcium chloride, 1.0 M sodium chloride, and 0.02% Tween 80 at pH 7.0, and eluted with 20 mM histidine, 20 mM calcium chloride, 1.5 M sodium chloride, and 0.02% Tween 80 dissolved in 50% ethylene glycol at pH 7.0.

Concentration and Buffer Exchange by Tangential Flow Filtration and Diafiltration Supernatant batches totaling at least 10 L in volume, from stable CHO cells lines expressing CFXTEN are filtered using a Cuno ZetaPlus Biocap filter and a Cuno BioAssure capsule. They are subsequently concentrated approximately 20-fold by tangential flow filtration using a Millipore Pellicon 2 Mini cartridge with a 30,000 Da MWCO. Using the same tangential flow filtration cartridge the sample is diafiltered with 10 mM histidine, 20 mM calcium chloride, 300 mM sodium chloride, and 0.02% Tween 80 at pH 7.0 10 mM tris pH 7.5, 1 mM EDTA with 5 volumes worth of buffer exchange. Samples are divided into 50 ml aliquots and frozen at −80° C.

Purification of CFXTEN by Anion Exchange Chromatography

Using an Akta FPLC system the sample is purified using a SuperQ-650M column. The column is equilibrated into buffer A (0.02 mol/L imidazole, 0.02 mol/L glycine ethyl-ester hydrochloride, 0.1 5 mol/L, NaCl, 2.5% glycerol, pH 6.9) and the sample loaded. The sample is eluted using buffer B (5 mmol/L histidine HCl (His/HCl), 1.15 mol/L NaCl, pH 7.0). The 215 nm chromatogram is used to monitor the elution profile. The eluted fractions are assayed for FVIII by ELISA, SDS-PAGE or activity assay. Peak fractions are pooled and stored or subjected to thrombin activation immediately (O'Brien et al., Blood (1990) 75:1664-1672). Fractions are assayed for FVIII activity using an aPTT based factor assay. A Bradford assay is performed to determine the total amount of protein in the load and elution fractions.

Purification of CFXTEN by Hydrophobic Interaction Chromatography

CFXTEN samples in Buffer A (50 mmol/l histidine, 1 mmol/l CaCl 2, 1 M NaCl, and 0.2 g/l Tween 80®, pH 7.0) are loaded onto a toyopearl ether 650M resin equilibrated in Buffer A. The column is washed with 10 column volumes of Buffer A to remove DNA, incorrectly folded forms and FVIII, and other contaminant proteins. The CFXTEN is eluted with Buffer B (25 mmol/l histidine, 0.5 mmol/l CaCl 2 and 0.4 mol/l NaCl, pH 7.0) as a single step elution (U.S. Pat. No. 6,005,082). Fractions are assayed for FVIII activity using an aPTT based factor assay. A Bradford assay is performed to determine the total amount of protein in the load and elution fractions.

Removal of Aggregated Protein from Monomeric CFXTEN with Anion Exchange Chromatography Using an Akta FPLC system the sample is purified using a macrocap Q column. The column is equilibrated into buffer A (20 mM MES, 1 mM $CaCl_2$, pH 7.0) and the sample is loaded. The sample is eluted using a linear gradient of 30% to 80% buffer B (20 mM MES, 1 mM $CaCl_2$, pH 7.0+500 mM NaCl) over 20 column volumes. The 215 nm chromatogram is used to monitor the elution profile. The fractions corresponding to the early portion of the elution contain primarily monomeric protein, while the late portion of the elution contains primarily the aggregated species. Fractions from the macrocapQ column is analyzed via size exclusion chromatography with 60 cm BioSep G4000 column to determine which to pool to create an aggregate free sample.

Activation of FVIII by Thrombin

Purified FVIII in 5 mmol/L histidine HCl (His/HCl), 1.15 mol/L NaCl, pH 7.0 is treated with thrombin at a 1:4 ratio of units of human thrombin to units FVIII, and the sample is incubated at 37° C. for up to 2 hours. To monitor the activation process, aliquots of this sample are then withdrawn, and acetone precipitated by the addition of 4.5 vol ice-cold acetone. The sample is incubated on ice for 10 minutes, and the precipitate is collected by centrifugation at 13,000 g in a microfuge for 3 minutes. The acetone is removed, and the precipitate is resuspended in 30 μL SDS-PAGE reducing sample buffer and boiled for 2 minutes. Samples are then assayed by SDS-PAGE or western blot. The conversion of FVIII to FVIIIa is examined by looking for the conversion of the heavy chain into 40 and 50 kDa fragments and the conversion of the light chain into a 70 kDa fragment (O'Brien et al., Blood (1990) 75:1664-1672).

SEC Analysis of CFXTEN

FVII-XTEN purified by affinity and anion exchange chromatography is analyzed by size exclusion chromatography with 60 cm BioSep G4000 column. A monodispersed population with a hydrodynamic radius of ~10 nm/apparent MW of ~1.7 MDa (XTEN-288 fusion) or ~12 nm/an apparent MW of 5.3 MDa (XTEN-864 fusion) is indicative of an aggregation-free sample. CFXTEN is expected to have an apparent molecular weight factor up to or about 8 (for an XTEN-288 fusion with FVIII) or up to or about ~15 (for an XTEN-864 fusion with FVIII).

ELISA Based Concentration Determination of CFXTEN

The quantitative determination of factor VIII/CFXTEN antigen concentrations using the double antibody enzyme linked immuno-sorbent assay (ELISA) is performed using proven antibody pairings (VisuLize™ FVIII Antigen kit, Affinity Biologicals, Ontario Canada). Strip wells are pre-coated with sheep polyclonal antibody to human FVIII. Plasma samples are diluted and applied to the wells. The FVIII antigen that is present binds to the coated antibody. After washing away unbound material, peroxidase-labeled sheep detecting antibody is applied and allowed to bind to the captured FVIII. The wells are again washed and a solution of TMB (the peroxidase substrate tetramethylbenzidine) is applied and allowed to react for a fixed period of time. A blue color develops which changes to yellow upon quenching the reaction with acid. The color formed is measured spectrophotometrically in a microplate reader at 450 nm. The absorbance at 450 nm is directly proportional to the quantity of FVIII antigen captured onto the well. The assay is calibrated using either the calibrator plasma provided in the kit or by substituting a CFXTEN standard in an appropriate matrix.

Assessment of CFXTEN Activity Via a FXa Coupled Chromogenic Substrate Assay

Using the Chromogenix Coamatic Factor VIII (Chromogenix, cat#82258563) the activity of FVIII or CFXTEN comprising FVIII is assessed as follows. In the presence of calcium ions and phospholipids, factor X is activated to factor Xa by factor IXa. This activation is greatly stimulated by factor VIII which acts as a cofactor in this reaction. By using optimal amounts of $Ca^{2+}$, phospholipid and factor IXa, and an excess of factor X, the rate of activation of factor X is linearly related to the amount of factor VIII. Factor Xa hydrolyses the chromogenic substrate S-2765 thus liberating the chromophoric group, pNA. The color is then read spectrophotometrically at 405 nm. The generated factor Xa and thus the intensity of color is proportional to the factor VIII activity in the sample. Hydrolysis of S-2765 by thrombin formed is prevented by the addition of the synthetic thrombin inhibitor 1-2581 together with the substrate. The activity of an unknown sample is determined by comparing final A405 of that sample to those from a standard curve constructed from known FVIII amounts. By also determining the amount of FVIII antigen present in the samples (via A280 or ELISA), a specific activity of a sample is determine to understand the relative potency of a particular preparation of FVIII. This enables the relative efficiency of different isolation strategies or construct designs for CFXTEN fusions to be assessed for activity and ranked.

aPTT Based Assays for CFXTEN Activity Determination

CFXTEN acts to replace FVIII in the intrinsic or contact activated coagulation pathway. The activity of this coagulation pathway is assessed using an activated partial thromboplastin time assay (aPTT). FVIII activity specifically is measured as follows: a standard curve is prepared by diluting normal control plasma (Pacific Hemostasis cat#100595) two-fold with FVIII deficient plasma (cat#100800) and then conducting 6.4-fold serial dilutions again with factor VIII deficient plasma. This creates a standard curve with points at 500, 130, 31, 7.8, 2.0, 0.5 and 0.1 IU/ml of activity, where one unit of activity is defined as the amount of FVIIIC activity in 1 ml of normal human plasma. A FVIII-deficient plasma also is included to determine the background level of activity in the null plasma. The sample is prepared by adding CFXTEN to FVIII deficient plasma at a ratio of 1:10 by volume. The samples is tested using an aPTT assay as follows. The samples are incubated at 37 C in a molecular devices plate reader spectrophotometer for 2 minutes at which point an equal volume of aPTT reagent (Pacific Hemostasis cat#100402) is added and an additional 3 minute 37 C incubation performed. After the incubation the assay is activated by adding one volume of calcium chloride (Pacific Hemostasis cat#100304). The turbidity is monitored at 450 nm for 5 minutes to create reaction profiles. The aPTT time, or time to onset of clotting activity, is defined as the first time where OD405 nm increased by 0.06 over baseline. A log—linear standard curve is created with the log of activity relating linearly to the aPTT time. From this the activity of the sample in the plate well is determined and then the activity in the sample is determined by multiplying by 11 to account for the dilution into the FVIII deficient plasma. By also determining the amount of FVIII antigen present in the samples (via A280 or ELISA), a specific activity of a sample can be determine to understand the relative potency of a particular preparation of FVIII. This enables the relative efficiency of different isolation strategies or construct designs for CFXTEN fusions to be ranked.

Western Blot Analysis of FVIII/FVIII-XTEN Expressed Proteins

Figure 22:
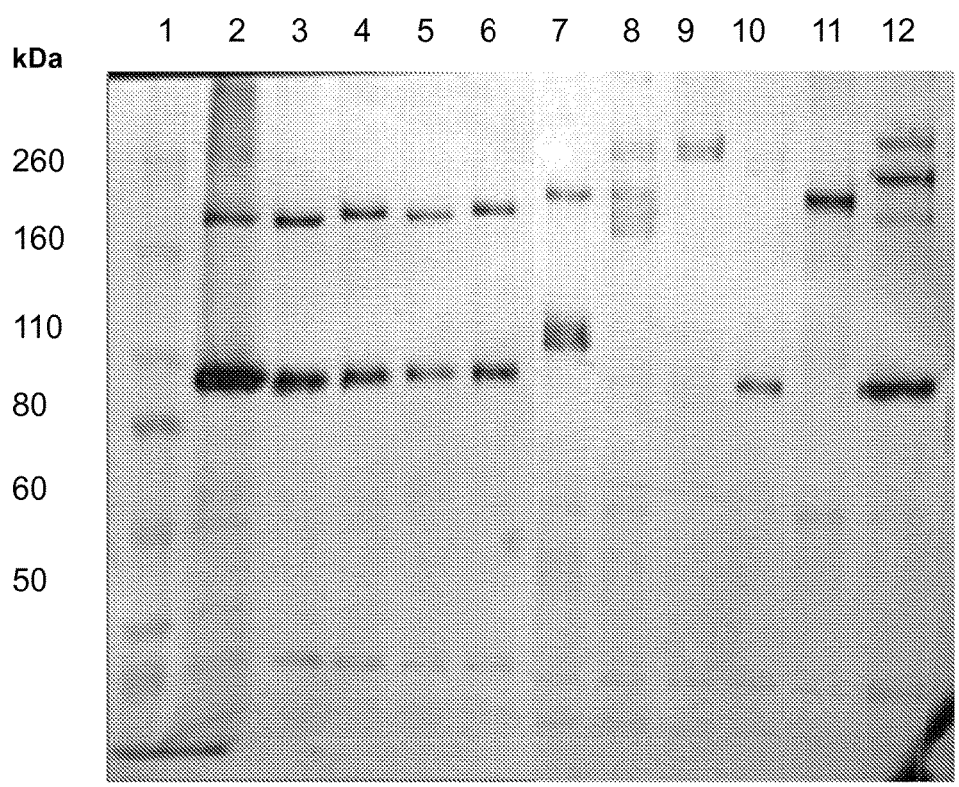
FIG. 22 shows results of a Western blot of proteins expressed by cell culture of cells transformed with constructs as designated (Example 25). The samples in lanes 1-12 were: MW Standards, FVIII (42.5 ng), pBC0100B, pBC0114A, pBC0100, pBC0114, pBC0135, pBC0136, pBC0137, pBC0145, pBC0149, and pBC0146, respectively. Lanes 8, 9 and 12 show bands consistent with a FVIII with a C-terminal XTEN288, with an estimated MW of 95 kDa. Lanes 7 and 11 show bands consistent with a FVIII with a C-terminal XTEN42, with an estimated MW of 175 kDa. Lanes 2-6 show bands consistent with FVIII and heavy chain. Lanes 10 and 23 show bands consistent with heavy chain. Lane 7 shows a band consistent with heavy chain and an attached XTEN42.

Samples were run on a 8% homogeneous SDS gel and subsequently transferred to PVDF membrane. The samples in lanes 1-15 were: MW Standards, FVIII(42.5 ng), pBC0100B, pBC0114A, pBC0100, pBC0114, pBC0126, pBC0127 (8/5/11; #9), pBC0128, pBC0135, pBC0136, pBC0137, pBC0145, pBC0149, and pBC0146, respectively. The membrane was initially blocked with 5% milk then probed with anti-FVIII monoclonal antibody, GMA-012, specific to the A2 domain of the heavy chain (Ansong C, Miles S M, Fay P J. J Thromb Haemost. 2006 April; 4(4):842-7). Insertion of XTEN288 in the B-domain was observed for pBC0136 (lane 8, FIG. 22) and pBC0137 (lane 9, FIG. 22), whereas XTEN288 insertion at the C-terminus was observed for pBC0146 (lane 12, FIG. 22). All of the assayed FVIII-XTEN proteins revealed the presence of single chain protein with molecular weight of at least 21 kDa higher than that of pBC0114 base construct or FVIII standard. In addition, AE42 insertion was observed for pBC0135 (lane 7, FIG. 22) and pBC0149 (lane 11, FIG. 22) with the single chain running ~5 kDa higher than that of pBC0114 base protein and heavy chain running at –5 kDa higher than 90 kDa band of the base protein.

Assay of Expressed FVIII by ELISA

To verify and quantitate the expression of FVIII-XTEN fusion proteins of the constructs by cell culture, an ELISA assay was established. Capture antibodies, either SAF8C-AP (Affinity Biologicals), or GMA-8002 (Green Mountain Antibodies), or GMA011 antibodies (Green Mountain Antibodies) for FVIII-LC ELISA) or by GMA016 antibodies were immobilized onto wells of an ELISA plate. The wells were then incubated with blocking buffer (1×PBS/3% BSA) to prevent non-specific binding of other proteins to the anti-FVIII antibody. FVIII standard dilutions (~50 ng-0.024 ng range), quality controls, and cell culture media samples were then incubated for 1.5 h in the wells to allow binding of the expressed FVIII protein to the coated antibody. Wells were then washed extensively, and bound protein is incubated with anti-FVIII detection antibody, SAF8C-Biotinylated (Affinity Biologicals). Then streptavidin-HRP, which binds the biotin conjugated to the FVIII detection antibody, is added to the well and incubated for 1 h. Finally, OPD substrate is added to the wells and its hydrolysis by HRP enzyme is monitored with a plate reader at 490 nm wavelength. Concentrations of FVIII-containing samples were then calculated by comparing the colorimetric response at each culture dilution to a standard curve. The results, in Table 22, below, show that FVIII-XTEN of the various constructs are expressed at 0.4-1 μg/ml in the cell culture media. The results obtained by ELISA and the activity data indicate that FVIII-XTEN fusion proteins were very well expressed using the described transfection methods. Furthermore, under the experimental conditions, the results demonstrate that the specific activity values of the FVIII-XTEN proteins were similar or greater than that of pBC0114 base construct (expressing BDD FVIII) and support that XTEN insertion into the C-terminus or B-domain of FVIII results in preservation of FVIII protein function.

Chromogenic Activity Assay for CFXTEN Fusion Protein

BDD FVIII and CFXTEN fusion protein constructs pBC0114, pBC0135, pBC0136, pBC0137, pBC0145, pBC0146, and pBC0149, in various configurations, including XTEN AE288 and AG288 inserted at the C-terminus of the FVIII BDD sequence and FVIII-XTEN fusion proteins with AE42 and AE288 inserted after residue 745 (or residue 743) and before residue 1640 (or residue 1638) of the B-domain (including constructs with the P1648 processing site mutated to alanine), were expressed in transiently transfected Freestyle 293 cells, as described above, and tested for procoagulant activity. The procoagulant activity of each of the FVIII-XTEN proteins present in cell culture medium was assessed using a Chromogenix Coamatic® Factor VIII assay, an assay in which the activation of factor X was linearly related to the amount of factor VIII in the sample. The assay was performed according to manufacturer's instructions using the end-point method, which was measured spectrophotometrically at OD405 nm. A standard curve was created using purified FVIII protein at concentrations of 250, 200, 150, 100, 75, 50, 37.5, 25, 12.5, 6.25, 3.125 and 1.56 mU/ml. Dilutions of factor VIII standard, quality controls, and samples were prepared with assay buffer and PEI culture medium to account for the effect of the medium in the assay performance. Positive controls consist of purified factor VIII protein at 20, 40, and 80 mU/ml concentrations and cell culture medium of pBC0114 FVIII base construct, lacking the XTEN insertions. Negative controls consisted of assay buffer or PEI culture medium alone. The cell culture media of the FVIII-XTEN constructs were obtained as described, above, and were tested in replicates at 1:50, 1:150, and 1:450 dilutions and the activity of each was calculated in U/ml. Each FVIII-XTEN construct exhibited procoagulant activity that was at least comparable, and in some cases greater than that of the base construct positive control, and support that under the conditions of the experiments, the linkage of XTEN, including AE288 or AG288, at the C-terminus of FVIII or insertion of XTEN, including AE42 or AE288 within the B-domain resulted in retention or even enhancement of FVIII procoagulant activity.

TABLE 22

Results of ELISA and Chromogenic FVIII activity assays

| FVIII-XTEN Construct | Activity (IU/ml) | Concentration (μg/ml) | Specific Activity (IU/mg) | Description of Construct |
|---|---|---|---|---|
| pBC0114 | 3.0 | 0.6 | 5000 | BDD FVIII base construct used for XTEN insertions |

TABLE 22-continued

Results of ELISA and Chromogenic FVIII activity assays

| FVIII-XTEN Construct | Activity (IU/ml) | Concentration (µg/ml) | Specific Activity (IU/mg) | Description of Construct |
|---|---|---|---|---|
| pBC0146 | 7.4 | 0.6 | 12759 | FVIII construct with XTEN AG288 inserted at the C-terminus of FVIII |
| pBC0145 | 3.1 | 0.6 | 4844 | FVIII construct with XTEN AE288 inserted at the C-terminus of FVIII |
| pBC0135 | 4.0 | 1.0 | 4124 | FVIII construct with XTEN AE42 inserted between residue 745 and 1640 |
| pBC0149 | 4.9 | 0.9 | 5581 | FVIII construct with XTEN AE42 inserted between residue 745 and 1640 and with Arg1648 to Ala mutation |
| pBC0136 | 2.7 | 0.4 | 7670 | FVIII construct with XTEN AE288 inserted between residue 745 and 1640 |
| pBC0137 | 1.9 | 0.3 | 6013 | FVIII construct with XTEN AE288 inserted between residue 745 and 1640 and with Arg1648 to Ala mutation |

Coatest Assay for Cell Culture Sample Activity Assay Containing CFXTEN Fusion Protein Using the Coatest assay, the activity of FVIII or CFXTEN comprising FVIII is assessed as follows.

Assay Matrix:

All wells in the same plate were adjusted to the same percentage of media to control for matrix effects. The test samples were diluted such that the OD405 reading would fall within the linear range of the standard. The range of concentrations for the FVIII standard was 100 mU/mL to 0.78 mU/mL, prepared by four-fold serial dilutions of the FVIII standard in 1× Coatest buffer (DiaPharma) plus the pre-determined percentage of culture media.

The Coatest SP FVIII (DiaPharma) reagent package includes the 10× Coatest buffer stock solution, factor IXa+factor X, phospholipid, $CaCl_2$ and substrate. The 1× Coatest solution was prepared by adding 9× volume of cold $ddH_2O$ to 1× volume of the stock. The cell culture media was then added to the prepared 1× solution at a pre-determined ratio to normalize the percentage of matrix in all test wells. Factor IXa+factor X, phospholipid, and substrate were reconstituted according to manufacturer's recommendations.

Coatest Assay Procedure:

Assay reagents were prepared and kept on ice until needed. 25 µl of the diluted test samples and standards were added to a 96 well plate in duplicate. 50 µl of phospholipid/factor IXa/factor X was added to each well and mixed by gently tapping the side of the plate. Plates were incubated at 37° C. for 5 min on a 37° C. plate heater. 25 µl of $CaCl_2$ was added to each well and mixed. The plates were incubated at 37° C. for 5 min on a plate heater. 50 µl of substrate was then added to each well, mixed, and the plates incubated at 37° C. for an additional 5-10 min until the top standard developed an OD405 reading of about 1.5. 25 µl of 20% acetic acid was added to each well with mixing to stop the reaction and wells were read at OD405 using a SpectraMAX® plus (Molecular Devices) spectrophotometer. Data analysis was performed using the SoftMax program (verion 5.2). The LLOQ varied per assay, but was generally 0.0039 IU/ml.

Results:

The data are presented in Tables 23-26. Table 23 presents results from CFXTEN fusion proteins with XTEN inserted in single sites chosen on the basis of criteria described herein, including Example 34. The pBC00114 FVIII positive control showed good expression and FVIII activity. Of the 106 single-XTEN fusion proteins assayed, 68% retained measurable FVIII activity, with 30% exhibiting 3+ to 4+ activity in the coagulation assay. Thirty-one percent of the fusion proteins assayed had results below the limits of quantitation (which may be due to poor expression, reflected in the corresponding expression ELISA results). All four B-domain insertion constructs exhibited good activity, as did the C-terminal linked constructs, indicating that these are likely favorable insertion sites The results of the single insertion site data guided the creation of XTEN constructs with 2 XTEN insertions, the results of which are presented in Table 24. Overall, the positivity rate was 67%, with 31% of fusion proteins exhibiting 3+ to 4+ activity in the coagulation assay.

The results of the foregoing data guided the creation of XTEN constructs with 3 XTEN insertions, the results of which are presented in Table 25. Overall, 92% of the samples had measurable FVIII activity, with fully 79% exhibiting 3+ to 4+ activity in the coagulation assay.

A limited number of constructs with 4 XTEN inserted in the A1, A2 and A3 domains were created and assayed, with 4 of 5 exhibiting FVIII activity (Table 26), suggesting that insertion of multiple XTEN does not compromise the ability of the resulting fusion proteins to retain FVIII activity.

Conclusions:

Under the conditions of the experiments, the results support that the criteria used to select XTEN insertion sites are valid, that insertion of one or more XTEN into the selected sites of FVIII is more likely than not to result in retention of procoagulant activity of the resulting CFXTEN molecule, and that insertion of three XTEN appears to result in a greater proportion of fusion proteins retaining high levels of FVIII procoagulant activity compared to single or double XTEN insertion constructs.

TABLE 23

Results of Coagulation Activity Assays for CFXTEN comprising one XTEN

| Insertion Site | Domain | Construct | Activity | Expression ELISA |
|---|---|---|---|---|
| pBC0114 |  |  | +++ | +++ |
| 3 | A1 | pBC0126 | LLOQ* | LLOQ |
| 3 | A1 | pBC0127 | + | + |
| 18 | A1 | pBC0165 | ++ | ++ |
| 22 | A1 | pBC0183 | +++ | ++ |
| 26 | A1 | pBC0184 | ++ | ++ |

TABLE 23-continued

Results of Coagulation Activity Assays for CFXTEN comprising one XTEN

| Insertion Site | Domain | Construct | Activity | Expression ELISA |
|---|---|---|---|---|
| 40 | A1 | pBC0166 | ++ | ++ |
| 60 | A1 | pBC0185 | LLOQ | LLOQ |
| 116 | A1 | pBC0167 | LLOQ | LLOQ |
| 130 | A1 | pBC0128 | LLOQ | LLOQ |
| 188 | A1 | pBC0168 | ++ | ++ |
| 216 | A1 | pBC0129 | ++ | ++ |
| 230 | A1 | pBC0169 | LLOQ | LLOQ |
| 333 | A1 | pBC0130 | ++ | ++ |
| 375 | A2 | pBC0131 | LLOQ | +++ |
| 403 | A2 | pBC0132 | ++ | ++ |
| 442 | A2 | pBC0170 | ++ | ++ |
| 490 | A2 | pBC0133 | + | ++ |
| 518 | A2 | pBC0171 | LLOQ | + |
| 599 | A2 | pBC0134 | ++ | ++ |
| 713 | A2 | pBC0172 | + | +++ |
| 745 | B | pBC0135 | +++ | +++ |
| 745 | B | pBC0149 | +++ | +++ |
| 745 | B | pBC0136 | ++ | ++ |
| 745 | B | pBC0137 | +++ | +++ |
| 1720 | A3 | pBC0138 | +++ | +++ |
| 1796 | A3 | pBC0139 | + | ++ |
| 1802 | A3 | pBC0140 | + | ++ |
| 1827 | A3 | pBC0173 | LLOQ | LLOQ |
| 1861 | A3 | pBC0174 | LLOQ | LLOQ |
| 1896 | A3 | pBC0175 | LLOQ | LLOQ |
| 1900 | A3 | pBC0176 | +++ | +++ |
| 1904 | A3 | pBC0177 | + | + |
| 1937 | A3 | pBC0178 | LLOQ | LLOQ |
| 2019 | A3 | pBC0141 | LLOQ | + |
| 2068 | C1 | pBC0179 | ++ | ++ |
| 2111 | C1 | pBC0180 | LLOQ | LLOQ |
| 2120 | C1 | pBC0142 | LLOQ | + |
| 2171 | C2 | pBC0143 | ++ | +++ |
| 2188 | C2 | pBC0181 | LLOQ | LLOQ |
| 2227 | C2 | pBC0182 | ++ | +++ |
| 2277 | C2 | pBC0144 | ++ | ++ |
| 2332 | CT | pBC0145 | +++ | +++ |
| 2332 | CT | pBC0146 | +++ | +++ |
| 403 | A2 | pSD0001 | +++ | +++ |
| 599 | A2 | pSD0002 | + | + |
| 403 | A2 | pSD0003 | +++ | +++ |
| 599 | A2 | pSD0004 | + | + |
| 745 | B | pSD0005 | +++ | ++ |
| 745 | B | pSD0006 | +++ | +++ |
| 745 | B | pSD0007 | +++ | ++ |
| 745 | B | pSD0008 | +++ | +++ |
| 1720 | A3 | pSD0009 | + | + |
| 1720 | A3 | pSD0010 | ++ | ++ |
| 2171 | C2 | pSD0011 | + | ++ |
| 2171 | C2 | pSD0012 | + | ++ |
| 2332 | CT | pSD0013 | +++ | ++ |
| 2332 | CT | pSD0014 | +++ | +++ |
| 745 | B | pSD0017 | +++ | +++ |
| 745 | B | pSD0018 | +++ | +++ |
| 2332 | CT | pSD0019 | +++ | +++ |
| 2332 | CT | pSD0020 | +++ | +++ |
| 2332 | CT | pSD0015 | ++ | ++ |
| 2332 | CT | pSD0016 | +++ | +++ |
| 0 | N-term | pSD0021 | + | + |
| 32 | A1 | pSD0022 | +++ | +++ |
| 65 | A1 | pSD0023 | LLOQ | LLOQ |
| 81 | A1 | pSD0024 | LLOQ | LLOQ |
| 119 | A1 | pSD0025 | LLOQ | LLOQ |
| 211 | A1 | pSD0026 | + | + |
| 220 | A1 | pSD0027 | + | + |
| 224 | A1 | pSD0028 | + | + |
| 336 | A1 | pSD0029 | ++ | +++ |
| 339 | A1 | pSD0030 | ++ | +++ |
| 378 | A2 | pSD0031 | LLOQ | ++ |
| 399 | A2 | pSD0032 | ++ | ++ |
| 409 | A2 | pSD0033 | ++ | ++ |
| 416 | A2 | pSD0034 | + | + |
| 487 | A2 | pSD0035 | LLOQ | + |
| 494 | A2 | pSD0036 | LLOQ | + |
| 500 | A2 | pSD0037 | LLOQ | + |
| 603 | A2 | pSD0038 | + | + |
| 1656 | A3 | pSD0039 | +++ | +++ |
| 1656 | A3 | pNL009** | ++++ | ND |
| 1711 | A3 | pSD0040 | ++ | + |
| 1725 | A3 | pSD0041 | LLOQ | ++ |
| 1749 | A3 | pSD0042 | LLOQ | LLOQ |
| 1905 | A3 | pSD0043 | ++ | ++ |
| 1910 | A3 | pSD0044 | + | + |
| 1900 | A3 | pSD0062 | ++ | ++ |
| 1900 | A3 | pSD0063 | +++ | ++ |
| 18 | A1 | pSD0045 | +++ | +++ |
| 18 | A1 | pSD0046 | +++ | +++ |
| 22 | A1 | pSD0047 | LLOQ | LLOQ |
| 22 | A1 | pSD0048 | LLOQ | LLOQ |
| 26 | A1 | pSD0049 | +++ | +++ |
| 26 | A1 | pSD0050 | +++ | +++ |
| 40 | A1 | pSD0051 | +++ | +++ |
| 40 | A1 | pSD0052 | +++ | +++ |
| 216 | A1 | pSD0053 | LLOQ | LLOQ |
| 216 | A1 | pSD0054 | LLOQ | LLOQ |
| 375 | A2 | pSD0055 | LLOQ | + |
| 442 | A2 | pSD0056 | LLOQ | LLOQ |
| 442 | A2 | pSD0057 | LLOQ | LLOQ |
| 1796 | A3 | pSD0058 | LLOQ | LLOQ |
| 1796 | A3 | pSD0059 | + | + |
| 1802 | A3 | pSD0060 | + | + |
| 1802 | A3 | pSD0061 | LLOQ | LLOQ |

*LLOQ: below the limits of quantitation
**pNL009 includes a deletion of 745-1656

TABLE 24

Results of Coagulation Activity Assays for CFXTEN comprising two XTEN

| Insertion 1 | | Insertion 2 | | | |
|---|---|---|---|---|---|
| Insertion Site | Domain | Insertion Site | Domain | Construct | Activity |
| 745 | B | 2332 | CT | LSD0001.002 | +++ |
| 745 | B | 2332 | CT | LSD0001.005 | +++ |
| 745 | B | 2332 | CT | LSD0001.006 | +++ |
| 745 | B | 2332 | CT | LSD0001.011 | +++ |
| 745 | B | 2332 | CT | LSD0001.012 | +++ |
| 745 | B | 2332 | CT | LSD0001.013 | +++ |
| 745 | B | 2332 | CT | LSD0001.016 | +++ |
| 745 | B | 2332 | CT | LSD0001.021 | +++ |
| 745 | B | 2332 | CT | LSD0002.001 | +++ |
| 745 | B | 2332 | CT | LSD0002.002 | +++ |
| 745 | B | 2332 | CT | LSD0002.014 | +++ |
| 745 | B | 2332 | CT | LSD0003.004 | +++ |
| 745 | B | 2332 | CT | LSD0003.006 | +++ |
| 745 | B | 2332 | CT | LSD0003.009 | +++ |
| 745 | B | 2332 | CT | LSD0003.014 | + |
| 745 | B | 2332 | CT | LSD0004.010 | +++ |
| 745 | B | 2332 | CT | LSD0004.011 | LLOQ |
| 745 | B | 2332 | CT | LSD0004.014 | +++ |
| 745 | B | 2332 | CT | LSD0004.016 | +++ |
| 745 | B | 2332 | CT | LSD0004.022 | +++ |
| 745 | B | 2332 | CT | LSD0003.016 | +++ |
| 0745 | B | 2332 | CT | pNL006 | +++ |
| 0745 | B | 2332 | CT | pNL007 | +++ |
| 0745 | B | 2332 | CT | pNL008 | ++ |
| 1656 | a3 | 2332 | CT | pNL010 | +++ |
| 26 | A1 | 403 | A2 | LSD0005.002 | ++ |
| 26 | A1 | 403 | A2 | LSD0005.004 | ++ |
| 40 | A1 | 403 | A2 | LSD0005.005 | ++ |
| 40 | A1 | 403 | A2 | LSD0005.011 | ++ |
| 18 | A1 | 403 | A2 | LSD0005.018 | ++ |

TABLE 24-continued

Results of Coagulation Activity Assays for CFXTEN comprising two XTEN

| Insertion 1 Insertion Site | Domain | Insertion 2 Insertion Site | Domain | Construct | Activity |
|---|---|---|---|---|---|
| 26 | A1 | 599 | A2 | LSD0006.002 | + |
| 40 | A1 | 599 | A2 | LSD0006.005 | ++ |
| 40 | A1 | 599 | A2 | LSD0006.007 | ++ |
| 40 | A1 | 599 | A2 | LSD0006.011 | +++ |
| 40 | A1 | 403 | A2 | LSD0007.002 | + |
| 40 | A1 | 403 | A2 | LSD0007.004 | + |
| 26 | A1 | 403 | A2 | LSD0007.013 | ++ |
| 26 | A1 | 599 | A2 | LSD0008.001 | ++ |
| 40 | A1 | 599 | A2 | LSD0008.002 | ++ |
| 26 | A1 | 599 | A2 | LSD0008.006 | + |
| 18 | A1 | 599 | A2 | LSD0008.009 | ++ |
| 40 | A1 | 599 | A2 | LSD0008.017 | + |
| 745 | B | 2332 | CT | LSD0002.025 | +++ |
| 745 | B | 2332 | CT | LSD0002.013 | +++ |
| 745 | B | 2332 | CT | LSD0003.025 | +++ |
| 745 | B | 2332 | CT | LSD0004.025 | +++ |
| 745 | B | 2332 | CT | LSD0003.005 | ++ |
| 26 | A1 | 403 | A2 | LSD0007.008 | ++ |
| 1720 | A3 | 1900 | A3 | LSD0044.002 | LLOQ |
| 1725 | A3 | 1900 | A3 | LSD0044.005 | LLOQ |
| 1720 | A3 | 1900 | A3 | LSD0044.039 | LLOQ |
| 1711 | A3 | 1905 | A3 | LSD0044.022 | LLOQ |
| 1720 | A3 | 1905 | A3 | LSD0044.003 | LLOQ |
| 1725 | A3 | 1905 | A3 | LSD0044.001 | LLOQ |
| 1656 | A3 | 26 | A1 | LSD0038.001 | ++ |
| 1656 | A3 | 18 | A1 | LSD0038.003 | ++ |
| 1656 | A3 | 18 | A1 | LSD0038.008 | +++ |
| 1656 | A3 | 40 | A1 | LSD0038.012 | ++ |
| 1656 | A3 | 40 | A1 | LSD0038.013 | ++ |
| 1656 | A3 | 26 | A1 | LSD0038.015 | ++ |
| 1656 | A3 | 399 | A2 | LSD0039.001 | + |
| 1656 | A3 | 403 | A2 | LSD0039.003 | ++ |
| 1656 | A3 | 403 | A2 | LSD0039.010 | ++ |
| 1656 | A3 | 1725 | A3 | LSD0045.001 | + |
| 1656 | A3 | 1720 | A3 | LSD0045.002 | ++ |
| 1900 | A3 | 18 | A1 | LSD0042.014 | + |
| 1900 | A3 | 18 | A1 | LSD0042.023 | + |
| 1900 | A3 | 26 | A1 | LSD0042.006 | + |
| 1900 | A3 | 26 | A1 | LSD0042.013 | ++ |
| 1900 | A3 | 40 | A1 | LSD0042.001 | + |
| 1900 | A3 | 40 | A1 | LSD0042.039 | + |
| 1900 | A3 | 26 | A1 | LSD0042.047 | + |
| 1905 | A3 | 18 | A1 | LSD0042.003 | + |
| 1905 | A3 | 40 | A1 | LSD0042.004 | LLOQ |
| 1905 | A3 | 26 | A1 | LSD0042.008 | LLOQ |
| 1905 | A3 | 26 | A1 | LSD0042.038 | LLOQ |
| 1905 | A3 | 40 | A1 | LSD0042.082 | LLOQ |
| 1910 | A3 | 26 | A1 | LSD0042.040 | LLOQ |
| 18 | A1 | 399 | A2 | LSD0037.002 | ++ |
| 26 | A1 | 399 | A2 | LSD0037.009 | + |
| 40 | A1 | 399 | A2 | LSD0037.011 | ++ |
| 18 | A1 | 403 | A2 | LSD0047.002 | ++ |
| 18 | A1 | 403 | A2 | LSD0047.005 | + |
| 18 | A1 | 403 | A2 | LSD0048.007 | + |
| 1656 | A3 | 1900 | A3 | LSD0046.001 | ++ |
| 1656 | A3 | 1900 | A3 | LSD0046.002 | + |
| 1656 | A3 | 1905 | A3 | LSD0046.003 | + |
| 1711 | A3 | 40 | A1 | LSD0040.011 | LLOQ |
| 1711 | A3 | 26 | A1 | LSD0040.042 | LLOQ |
| 1720 | A3 | 26 | A1 | LSD0040.002 | + |
| 1720 | A3 | 40 | A1 | LSD0040.008 | + |
| 1720 | A3 | 18 | A1 | LSD0040.021 | + |
| 1720 | A3 | 26 | A1 | LSD0040.037 | LLOQ |
| 1720 | A3 | 18 | A1 | LSD0040.046 | + |
| 1725 | A3 | 26 | A1 | LSD0040.003 | LLOQ |
| 1725 | A3 | 40 | A1 | LSD0040.006 | LLOQ |
| 1725 | A3 | 26 | A1 | LSD0040.007 | LLOQ |
| 1725 | A3 | 18 | A1 | LSD0040.010 | LLOQ |
| 1725 | A3 | 40 | A1 | LSD0040.039 | LLOQ |
| 1725 | A3 | 18 | A1 | LSD0040.052 | + |
| 1720 | A3 | 403 | A2 | LSD0041.001 | + |
| 1720 | A3 | 399 | A2 | LSD0041.004 | LLOQ |
| 1711 | A3 | 403 | A2 | LSD0041.006 | LLOQ |
| 1720 | A3 | 403 | A2 | LSD0041.008 | LLOQ |
| 1725 | A3 | 403 | A2 | LSD0041.010 | LLOQ |
| 1725 | A3 | 403 | A2 | LSD0041.014 | LLOQ |
| 1725 | A3 | 399 | A2 | LSD0041.016 | LLOQ |
| 1711 | A3 | 403 | A2 | LSD0041.035 | LLOQ |
| 1900 | A3 | 399 | A2 | LSD0043.001 | LLOQ |
| 1900 | A3 | 403 | A2 | LSD0043.002 | LLOQ |
| 1905 | A3 | 403 | A2 | LSD0043.005 | LLOQ |
| 1900 | A3 | 399 | A2 | LSD0043.006 | LLOQ |
| 1900 | A3 | 403 | A2 | LSD0043.007 | LLOQ |
| 1900 | A3 | 403 | A2 | LSD0043.008 | LLOQ |
| 1905 | A3 | 399 | A2 | LSD0043.015 | LLOQ |
| 1905 | A3 | 403 | A2 | LSD0043.029 | LLOQ |
| 1910 | A3 | 403 | A2 | LSD0043.043 | LLOQ |

TABLE 25

Results of Coagulation Activity Assays for CFXTEN comprising three XTEN

| Insertion 1 Insertion Site | Domain | Insertion 2 Insertion Site | Domain | Insertion 3 Insertion Site | Domain | Construct | Activity |
|---|---|---|---|---|---|---|---|
| 26 | A1 | 403 | A2 | 1656 | A3 | pSD0077 | +++ |
| 26 | A1 | 403 | A2 | 1720 | A3 | pSD0078 | ++ |
| 26 | A1 | 403 | A2 | 1900 | A3 | pSD0079 | ++ |
| 26 | A1 | 1656 | A3 | 1720 | A3 | pSD0080 | +++ |
| 26 | A1 | 1656 | A3 | 1900 | A3 | pSD0081 | LLOQ |
| 26 | A1 | 1720 | A3 | 1900 | A3 | pSD0082 | + |
| 403 | A2 | 1656 | A3 | 1720 | A3 | pSD0083 | +++ |
| 403 | A2 | 1656 | A3 | 1900 | A3 | pSD0084 | +++ |
| 403 | A2 | 1720 | A3 | 1900 | A3 | pSD0085 | + |
| 1656 | A3 | 1720 | A3 | 1900 | A3 | pSD0086 | +++ |
| 18 | A1 | 745 | B | 2332 | CT | LSD0049.002 | +++ |
| 26 | A1 | 745 | B | 2332 | CT | LSD0049.008 | +++ |
| 26 | A1 | 745 | B | 2332 | CT | LSD0049.011 | +++ |
| 40 | A1 | 745 | B | 2332 | CT | LSD0049.012 | +++ |
| 40 | A1 | 745 | B | 2332 | CT | LSD0049.020 | +++ |
| 18 | A1 | 745 | B | 2332 | CT | LSD0049.021 | +++ |
| 40 | A1 | 745 | B | 2332 | CT | LSD0050.002 | +++ |

TABLE 25-continued

Results of Coagulation Activity Assays for CFXTEN comprising three XTEN

| Insertion 1 | | Insertion 2 | | Insertion 3 | | | |
|---|---|---|---|---|---|---|---|
| Insertion Site | Domain | Insertion Site | Domain | Insertion Site | Domain | Construct | Activity |
| 18 | A1 | 745 | B | 2332 | CT | LSD0050.003 | +++ |
| 26 | A1 | 745 | B | 2332 | CT | LSD0050.007 | LLOQ |
| 18 | A1 | 745 | B | 2332 | CT | LSD0050.010 | +++ |
| 26 | A1 | 745 | B | 2332 | CT | LSD0050.012 | +++ |
| 40 | A1 | 745 | B | 2332 | CT | LSD0050.014 | +++ |
| 403 | A2 | 745 | B | 2332 | CT | LSD0051.002 | +++ |
| 399 | A2 | 745 | B | 2332 | CT | LSD0051.003 | +++ |
| 403 | A2 | 745 | B | 2332 | CT | LSD0052.001 | +++ |
| 399 | A2 | 745 | B | 2332 | CT | LSD0052.003 | +++ |
| 1725 | A3 | 745 | B | 2332 | CT | LSD0053.021 | LLOQ |
| 1720 | A3 | 745 | B | 2332 | CT | LSD0053.022 | +++ |
| 1711 | A3 | 745 | B | 2332 | CT | LSD0053.024 | +++ |
| 1720 | A3 | 745 | B | 2332 | CT | LSD0054.021 | +++ |
| 1711 | A3 | 745 | B | 2332 | CT | LSD0054.025 | +++ |
| 1725 | A3 | 745 | B | 2332 | CT | LSD0054.026 | +++ |
| 1900 | A3 | 745 | B | 2332 | CT | LSD0055.021 | +++ |
| 1905 | A3 | 745 | B | 2332 | CT | LSD0055.022 | +++ |
| 1900 | A3 | 745 | B | 2332 | CT | LSD0055.026 | +++ |
| 1900 | A3 | 745 | B | 2332 | CT | LSD0056.021 | +++ |
| 1900 | A3 | 745 | B | 2332 | CT | LSD0056.024 | +++ |
| 1910 | A3 | 745 | B | 2332 | CT | LSD0056.025 | +++ |
| 0745 | B | 1900 | A3 | 2332 | CT | pBC0294* | |
| 0745 | B | 1900 | A3 | 2332 | CT | pBC0295* | |
| 0745 | B | 1900 | A3 | 2332 | CT | pBC0296* | |
| 0745 | B | 1900 | A3 | 2332 | CT | pBC0297* | |
| 0745 | B | 1900 | A3 | 2332 | CT | pBC0298* | |
| 0745 | B | 1900 | A3 | 2332 | CT | pBC0299* | |
| 0745 | B | 1900 | A3 | 2332 | CT | pBC0300* | |
| 0745 | B | 1900 | A3 | 2332 | CT | pBC0301* | |
| 0745 | B | 1900 | A3 | 2332 | CT | pBC0302* | |
| 0745 | B | 1900 | A3 | 2332 | CT | pBC0303* | |
| 0745 | B | 1900 | A3 | 2332 | CT | pBC0304* | |
| 0745 | B | 1900 | A3 | 2332 | CT | pBC0305* | |
| 0745 | B | 1900 | A3 | 2332 | CT | pBC0306* | |
| 0745 | B | 1900 | A3 | 2332 | CT | pBC0307* | |
| 0745 | B | 1900 | A3 | 2332 | CT | pBC0308* | |
| 0745 | B | 1900 | A3 | 2332 | CT | pBC0309* | |
| 0745 | B | 1900 | A3 | 2332 | CT | pBC0310* | |
| 0745 | B | 1900 | A3 | 2332 | CT | pBC0311* | |
| 0745 | B | 1900 | A3 | 2332 | CT | pBC0312* | |
| 0745 | B | 1900 | A3 | 2332 | CT | pBC0313* | |
| 0745 | B | 1900 | A3 | 2332 | CT | pBC0314* | |
| 0745 | B | 1900 | A3 | 2332 | CT | pBC0315* | |
| 0745 | B | 1900 | A3 | 2332 | CT | pBC0316* | |
| 0745 | B | 1900 | A3 | 2332 | CT | pBC0317* | |
| 0745 | B | 1900 | A3 | 2332 | CT | pBC0318* | |
| 0745 | B | 1900 | A3 | 2332 | CT | pBC0319* | |
| 0745 | B | 1900 | A3 | 2332 | CT | pBC0320* | |
| 0018 | A1 | 0745 | B | 2332 | CT | pBC0269* | |
| 0403 | A2 | 0745 | B | 2332 | CT | pBC0270* | |
| 1720 | A3 | 0745 | B | 2332 | CT | pBC0271* | |
| 1900 | A3 | 0745 | B | 2332 | CT | pBC0272* | |
| 0403 | A2 | 0745 | B | 2332 | CT | pBC0273* | |
| 1720 | A3 | 0745 | B | 2332 | CT | pBC0274* | |
| 1900 | A3 | 0745 | B | 2332 | CT | pBC0275* | |
| 0018 | A1 | 0745 | B | 2332 | CT | pBC0276* | |
| 0403 | A2 | 0745 | B | 2332 | CT | pBC0277* | |
| 1720 | A3 | 0745 | B | 2332 | CT | pBC0278* | |
| 1900 | A3 | 0745 | B | 2332 | CT | pBC0279* | |

*Construct with R1648A mutation

TABLE 26

Results of Coagulation Activity Assays for CFXTEN comprising four XTEN

| XTEN Insert 1 | XTEN Insert 2 | XTEN Insert 3 | XTEN Insert 4 | XTEN Insert 5 | XTEN Insert 6 | Construct ID | Activity |
|---|---|---|---|---|---|---|---|
| 26 | 403 | 1656 | 1720 | — | — | pSD0087 | +++ |
| 26 | 403 | 1656 | 1900 | — | — | pSD0088 | +++ |
| 26 | 403 | 1720 | 1900 | — | — | pSD0089 | LLOQ |

TABLE 26-continued

Results of Coagulation Activity Assays
for CFXTEN comprising four XTEN

| XTEN Insert 1 | XTEN Insert 2 | XTEN Insert 3 | XTEN Insert 4 | XTEN Insert 5 | XTEN Insert 6 | Construct ID | Activity |
|---|---|---|---|---|---|---|---|
| 26 | 1656 | 1720 | 1900 | — | — | pSD0090 | ++ |
| 403 | 1656 | 1720 | 1900 | — | — | pSD0091 | ++ |
| 0040 | 0403 | 745 | 2332 | — | — | LSD0058.006* | ++ |
| 0018 | 0409 | 745 | 2332 | — | — | LSD0059.002* | + |
| 0040 | 0409 | 745 | 2332 | — | — | LSD0059.006* | + |
| 0040 | 0409 | 745 | 2332 | — | — | LSD0060.001* | + |
| 0018 | 0409 | 745 | 2332 | — | — | LSD0060.003* | + |
| 0040 | 1720 | 745 | 2332 | — | — | LSD0061.002* | + |
| 0026 | 1720 | 745 | 2332 | — | — | LSD0061.007* | ++ |
| 0018 | 1720 | 745 | 2332 | — | — | LSD0061.008* | ++ |
| 0018 | 1720 | 745 | 2332 | — | — | LSD0061.012* | ++ |
| 0018 | 1720 | 745 | 2332 | — | — | LSD0062.001* | ++ |
| 0026 | 1720 | 745 | 2332 | — | — | LSD0062.002* | ++ |
| 0018 | 1720 | 745 | 2332 | — | — | LSD0062.006* | ++ |
| 0018 | 1900 | 745 | 2332 | — | — | LSD0063.001* | ++ |
| 0018 | 1900 | 745 | 2332 | — | — | LSD0064.017* | ++ |
| 0026 | 1900 | 745 | 2332 | — | — | LSD0064.020* | ++ |
| 0040 | 1900 | 745 | 2332 | — | — | LSD0064.021* | ++ |
| 0040 | 1905 | 745 | 2332 | — | — | LSD0065.001* | + |
| 0018 | 1905 | 745 | 2332 | — | — | LSD0065.014* | + |
| 0040 | 1905 | 745 | 2332 | — | — | LSD0066.001* | + |
| 0026 | 1905 | 745 | 2332 | — | — | LSD0066.002* | + |
| 0018 | 1905 | 745 | 2332 | — | — | LSD0066.009* | ++ |
| 0018 | 1905 | 745 | 2332 | — | — | LSD0066.011* | ++ |
| 0018 | 1910 | 745 | 2332 | — | — | LSD0067.004* | ++ |
| 0018 | 1910 | 745 | 2332 | — | — | LSD0067.005* | + |
| 0040 | 1910 | 745 | 2332 | — | — | LSD0067.006* | + |
| 0026 | 1910 | 745 | 2332 | — | — | LSD0067.008* | + |
| 0018 | 1910 | 745 | 2332 | — | — | LSD0068.001* | + |
| 0026 | 1910 | 745 | 2332 | — | — | LSD0068.002* | + |
| 0040 | 1910 | 745 | 2332 | — | — | LSD0068.005* | + |
| 0018 | 1910 | 745 | 2332 | — | — | LSD0068.010* | ++ |
| 0409 | 1720 | 745 | 2332 | — | — | LSD0069.004* | + |
| 0403 | 1720 | 745 | 2332 | — | — | LSD0069.008* | + |
| 0409 | 1720 | 745 | 2332 | — | — | LSD0070.003* | + |
| 0403 | 1720 | 745 | 2332 | — | — | LSD0070.004* | ++ |
| 0403 | 1720 | 745 | 2332 | — | — | LSD0070.005* | ++ |
| 0403 | 1900 | 745 | 2332 | — | — | LSD0071.001* | ++ |
| 0403 | 1900 | 745 | 2332 | — | — | LSD0071.002* | + |
| 0409 | 1900 | 745 | 2332 | — | — | LSD0071.008* | ++ |
| 0403 | 1900 | 745 | 2332 | — | — | LSD0072.001* | ++ |
| 0403 | 1900 | 745 | 2332 | — | — | LSD0072.002* | + |
| 0409 | 1900 | 745 | 2332 | — | — | LSD0072.003* | + |
| 0409 | 1905 | 745 | 2332 | — | — | LSD0073.002* | + |
| 0403 | 1905 | 745 | 2332 | — | — | LSD0073.004* | + |
| 0403 | 1905 | 745 | 2332 | — | — | LSD0073.006* | + |
| 0403 | 1905 | 745 | 2332 | — | — | LSD0074.007* | ++ |
| 0409 | 1905 | 745 | 2332 | — | — | LSD0074.010* | + |
| 0403 | 1905 | 745 | 2332 | — | — | LSD0074.011* | + |
| 0409 | 1910 | 745 | 2332 | — | — | LSD0075.004* | + |
| 0403 | 1910 | 745 | 2332 | — | — | LSD0075.007* | + |
| 0403 | 1910 | 745 | 2332 | — | — | LSD0076.002* | + |
| 0403 | 1910 | 745 | 2332 | — | — | LSD0076.003* | + |
| 0403 | 1910 | 745 | 2332 | — | — | pSD0093* | + |
| 1720 | 1900 | 745 | 2332 | — | — | pSD0094* | ++ |
| 1720 | 1905 | 745 | 2332 | — | — | pSD0095* | + |
| 1720 | 1910 | 745 | 2332 | — | — | pSD0097* | + |
| 1720 | 1910 | 745 | 2332 | — | — | pSD0098* | + |
| 0403 | 1656 | 1720 | 2332 | — | — | pNL0022 | + |
| 0403 | 1656 | 1900 | 2332 | — | — | pNL0023 | + |
| 0403 | 1720 | 1900 | 2332 | — | — | pNL0024 | LLOQ |
| 1656 | 1720 | 1900 | 2332 | — | — | pNL0025 | + |
| 0018 | 0403 | 1656 | 2332 | — | — | pBC0247 | ++ |
| 0018 | 0403 | 1720 | 2332 | — | — | pBC0248 | + |
| 0018 | 0403 | 1900 | 2332 | — | — | pBC0249 | + |
| 0018 | 1656 | 1720 | 2332 | — | — | pBC0250 | + |
| 0018 | 1656 | 1900 | 2332 | — | — | pBC0251 | ++ |

TABLE 26-continued

Results of Coagulation Activity Assays
for CFXTEN comprising four XTEN

| XTEN Insert 1 | XTEN Insert 2 | XTEN Insert 3 | XTEN Insert 4 | XTEN Insert 5 | XTEN Insert 6 | Construct ID | Activity |
|---|---|---|---|---|---|---|---|
| 0018 | 1720 | 1900 | 2332 | — | — | pBC0252 | LLOQ |
| 0018 | 0403 | 0745 | 2332 | — | — | LSD57.005 | ++ |
| 0018 | 0745 | 1720 | 2332 | — | — | LSD62.001 | ++ |
| 0018 | 0745 | 1900 | 2332 | — | — | pBC0262 | ++ |
| 0403 | 0745 | 1720 | 2332 | — | — | LSD70.004 | + |
| 0403 | 0745 | 1900 | 2332 | — | — | pBC0266 | + |
| 0745 | 1720 | 1900 | 2332 | — | — | pBC0268 | + |
| 0188 | 1900 | 0745 | 2332 | — | — | pCS0001* | ND |
| 0599 | 1900 | 0745 | 2332 | — | — | pCS0002* | ND |
| 2068 | 1900 | 0745 | 2332 | — | — | pCS0003* | ND |
| 2171 | 1900 | 0745 | 2332 | — | — | pCS0004* | ND |
| 2227 | 1900 | 0745 | 2332 | — | — | pCS0005* | ND |
| 2277 | 1900 | 0745 | 2332 | — | — | pCS0006* | ND |
| 0403 | 1656 | 1720 | 1900 | 2332 | — | pNL0030 | LLOQ |
| 0018 | 0403 | 1656 | 1720 | 2332 | — | pBC0253 | + |
| 0018 | 0403 | 1656 | 1900 | 2332 | — | pBC0254 | + |
| 0018 | 0403 | 1720 | 1900 | 2332 | — | pBC0255 | LLOQ |
| 0018 | 1656 | 1720 | 1900 | 2332 | — | pBC0256 | + |
| 0018 | 0403 | 0745 | 1720 | 2332 | — | pBC0259* | + |
| 0018 | 0403 | 0745 | 1900 | 2332 | — | pBC0260* | + |
| 0018 | 0745 | 1720 | 1900 | 2332 | — | pBC0263 | + |
| 0403 | 0745 | 1720 | 1900 | 2332 | — | pBC0267 | LLOQ |
| 0018 | 0403 | 1656 | 1720 | 1900 | 2332 | pBC0257 | LLOQ |
| 0018 | 0403 | 0745 | 1720 | 1900 | 2332 | pBC0264 | LLOQ |

*Construct with R1648A mutation

Example 26: Determination of XTEN Radii and Related Parameters

In order to quantify the hydrodynamic radii of the XTEN components of CFXTEN fusion proteins and how the value of multiple XTEN versus single XTEN varies, a series of formulae were created based on empirically-derived data from size exclusion chromatography assays of various fusion proteins comprising one or more XTEN. It is believed that the incorporation of multiple XTEN into a CFXTEN provides a higher total hydrodynamic radius of the XTEN component compared to CFXTEN with fewer XTEN yet having approximately the same total of XTEN amino acids. The maximum radius of a single XTEN polypeptide is calculated (hereinafter "XTEN Radius") according to the formula given by Equation II:

$$\text{XTEN Radius} = (\sqrt{\text{XTEN length}} \cdot 0.2037) + 3.4627 \quad \text{II}$$

The sum of the maximum of the XTEN Radii for all XTEN segments in a CFXTEN is calculated (hereinafter "Sum XTEN Radii") according to the formula given by Equation III:

$$\text{Sum } XTEN \text{ Radii} = \sum_{i=1}^{m} XTEN \text{ Radius}_i \quad \text{III}$$

wherein: n=the number of XTEN segments
and i is an iterator

The ratio of the SUM XTEN Radii of a CFXTEN comprising multiple XTEN to that of an XTEN Radius for a single XTEN of an equivalent length (in total amino acid residues to that of the CFXTEN) is calculated (hereinafter "Ratio XTEN Radii") according to the formula given by Equation IV:

$$\text{Ratio } XTEN \text{ Radii} = \frac{\sum_{i=1}^{n} XTEN \text{ Radius}_i}{\left(\sqrt{\sum_{i=1}^{n} XTEN \text{ Length}_i} \cdot 0.2037\right) + 3.4627} \quad \text{IV}$$

wherein: n=the number of XTEN segments
and i is an iterator

Results:

Equation II was applied to XTEN of lengths 144, 288, 576 and 864. The results are presented in Table 27. Equation IV was applied to various CFXTEN fusion proteins described herein with two, three, or four XTEN. The Ratio of XTEN Radii has a value of 1 for all CFXTEN that contain a single XTEN. The Ratio XTEN Radii are presented in Table 28. The Ratio of XTEN Radii for pSD0092, which contains 5 XTEN insertions, has a value of 3.31. Collectively, the results indicate that the inclusion of multiple XTEN increases the Ratio XTEN Radii to values greater than 2, with four insertions resulting in higher values than three insertions.

TABLE 27

Results of Radii Calculations for
CFXTEN comprising XTEN

| XEN Length | XTEN Radius |
|---|---|
| 42 | 4.8 |
| 144 | 5.9 |
| 288 | 6.9 |
| 576 | 8.4 |
| 864 | 9.5 |

TABLE 28

Results of Radii Calculations for CFXTEN comprising XTEN

| Insertion 1 | | Insertion 2 | | Insertion 3 | | Insertion 4 | | | Ratio |
|---|---|---|---|---|---|---|---|---|---|
| Insert Site | Domain | Insert Site | Domain | Insert Site | Domain | Insert Site | Domain | Construct | XTEN Radii |
| 40 | A1 | | | | | | | pBC0166 | 1.00 |
| 745 | B | 2332 | CT | | | | | LSD0001.002 | 1.67 |
| 745 | B | 2332 | CT | | | | | LSD0001.005 | 1.71 |
| 745 | B | 2332 | CT | | | | | LSD0001.006 | 1.71 |
| 745 | B | 2332 | CT | | | | | LSD0001.011 | 1.71 |
| 745 | B | 2332 | CT | | | | | LSD0001.012 | 1.71 |
| 745 | B | 2332 | CT | | | | | LSD0001.013 | 1.67 |
| 745 | B | 2332 | CT | | | | | LSD0001.016 | 1.67 |
| 745 | B | 2332 | CT | | | | | LSD0001.021 | 1.67 |
| 745 | B | 2332 | CT | | | | | LSD0002.001 | 1.67 |
| 745 | B | 2332 | CT | | | | | LSD0002.002 | 1.67 |
| 745 | B | 2332 | CT | | | | | LSD0002.004 | 1.71 |
| 745 | B | 2332 | CT | | | | | LSD0002.008 | 1.67 |
| 745 | B | 2332 | CT | | | | | LSD0002.014 | 1.67 |
| 745 | B | 2332 | CT | | | | | LSD0003.001 | 1.67 |
| 745 | B | 2332 | CT | | | | | LSD0003.004 | 1.66 |
| 745 | B | 2332 | CT | | | | | LSD0003.006 | 1.67 |
| 745 | B | 2332 | CT | | | | | LSD0003.009 | 1.67 |
| 745 | B | 2332 | CT | | | | | LSD0003.014 | 1.66 |
| 745 | B | 2332 | CT | | | | | LSD0003.018 | 1.67 |
| 745 | B | 2332 | CT | | | | | LSD0004.010 | 1.66 |
| 745 | B | 2332 | CT | | | | | LSD0004.011 | 1.67 |
| 745 | B | 2332 | CT | | | | | LSD0004.014 | 1.66 |
| 745 | B | 2332 | CT | | | | | LSD0004.016 | 1.66 |
| 745 | B | 2332 | CT | | | | | LSD0004.022 | 1.66 |
| 745 | B | 2332 | CT | | | | | LSD0003.016 | 1.67 |
| 26 | A1 | 403 | A2 | | | | | LSD0005.002 | 1.71 |
| 26 | A1 | 403 | A2 | | | | | LSD0005.004 | 1.71 |
| 40 | A1 | 403 | A2 | | | | | LSD0005.005 | 1.71 |
| 40 | A1 | 403 | A2 | | | | | LSD0005.011 | 1.71 |
| 18 | A1 | 403 | A2 | | | | | LSD0005.018 | 1.71 |
| 26 | A1 | 599 | A2 | | | | | LSD0006.002 | 1.71 |
| 40 | A1 | 599 | A2 | | | | | LSD0006.005 | 1.71 |
| 40 | A1 | 599 | A2 | | | | | LSD0006.007 | 1.71 |
| 40 | A1 | 599 | A2 | | | | | LSD0006.011 | 1.71 |
| 40 | A1 | 403 | A2 | | | | | LSD0007.002 | 1.71 |
| 40 | A1 | 403 | A2 | | | | | LSD0007.004 | 1.71 |
| 26 | A1 | 403 | A2 | | | | | LSD0007.013 | 1.71 |
| 26 | A1 | 599 | A2 | | | | | LSD0008.001 | 1.71 |
| 40 | A1 | 599 | A2 | | | | | LSD0008.002 | 1.71 |
| 26 | A1 | 599 | A2 | | | | | LSD0008.006 | 1.71 |
| 18 | A1 | 599 | A2 | | | | | LSD0008.009 | 1.71 |
| 40 | A1 | 599 | A2 | | | | | LSD0008.017 | 1.71 |
| 745 | B | 2332 | CT | | | | | LSD0002.025 | 1.71 |
| 745 | B | 2332 | CT | | | | | LSD0002.013 | 1.67 |
| 745 | B | 2332 | CT | | | | | LSD0003.025 | 1.67 |
| 745 | B | 2332 | CT | | | | | LSD0004.025 | 1.67 |
| 745 | B | 2332 | CT | | | | | LSD0003.005 | 1.66 |
| 26 | A1 | 403 | A2 | | | | | LSD0007.008 | 1.71 |
| 1720 | A3 | 1900 | A3 | | | | | LSD0044.002 | 1.71 |
| 1725 | A3 | 1900 | A3 | | | | | LSD0044.005 | 1.71 |
| 1720 | A3 | 1900 | A3 | | | | | LSD0044.039 | 1.71 |
| 1711 | A3 | 1905 | A3 | | | | | LSD0044.022 | 1.71 |
| 1720 | A3 | 1905 | A3 | | | | | LSD0044.003 | 1.71 |
| 1725 | A3 | 1905 | A3 | | | | | LSD0044.001 | 1.71 |
| 1656 | A3 | 26 | A1 | | | | | LSD0038.001 | 1.71 |
| 1656 | A3 | 18 | A1 | | | | | LSD0038.003 | 1.71 |
| 1656 | A3 | 18 | A1 | | | | | LSD0038.008 | 1.71 |
| 1656 | A3 | 40 | A1 | | | | | LSD0038.012 | 1.71 |
| 1656 | A3 | 40 | A1 | | | | | LSD0038.013 | 1.71 |
| 1656 | A3 | 26 | A1 | | | | | LSD0038.015 | 1.71 |
| 1656 | A3 | 399 | A2 | | | | | LSD0039.001 | 1.71 |
| 1656 | A3 | 403 | A2 | | | | | LSD0039.003 | 1.71 |
| 1656 | A3 | 403 | A2 | | | | | LSD0039.010 | 1.71 |
| 1656 | A3 | 1725 | A3 | | | | | LSD0045.001 | 1.71 |
| 1656 | A3 | 1720 | A3 | | | | | LSD0045.002 | 1.71 |
| 1900 | A3 | 18 | A1 | | | | | LSD0042.014 | 1.71 |
| 1900 | A3 | 18 | A1 | | | | | LSD0042.023 | 1.71 |
| 1900 | A3 | 26 | A1 | | | | | LSD0042.006 | 1.71 |
| 1900 | A3 | 26 | A1 | | | | | LSD0042.013 | 1.71 |
| 1900 | A3 | 40 | A1 | | | | | LSD0042.001 | 1.71 |
| 1900 | A3 | 40 | A1 | | | | | LSD0042.039 | 1.71 |
| 1900 | A3 | 26 | A1 | | | | | LSD0042.047 | 1.71 |

TABLE 28-continued

Results of Radii Calculations for CFXTEN comprising XTEN

| Insertion 1 | | Insertion 2 | | Insertion 3 | | Insertion 4 | | | Ratio |
|---|---|---|---|---|---|---|---|---|---|
| Insert Site | Domain | Insert Site | Domain | Insert Site | Domain | Insert Site | Domain | Construct | XTEN Radii |
| 1905 | A3 | 18 | A1 | | | | | LSD0042.003 | 1.71 |
| 1905 | A3 | 40 | A1 | | | | | LSD0042.004 | 1.71 |
| 1905 | A3 | 26 | A1 | | | | | LSD0042.008 | 1.71 |
| 1905 | A3 | 26 | A1 | | | | | LSD0042.038 | 1.71 |
| 1905 | A3 | 40 | A1 | | | | | LSD0042.082 | 1.71 |
| 1910 | A3 | 26 | A1 | | | | | LSD0042.040 | 1.71 |
| 18 | A1 | 399 | A2 | | | | | LSD0037.002 | 1.71 |
| 26 | A1 | 399 | A2 | | | | | LSD0037.009 | 1.71 |
| 40 | A1 | 399 | A2 | | | | | LSD0037.011 | 1.71 |
| 18 | A1 | 403 | A2 | | | | | LSD0047.002 | 1.71 |
| 18 | A1 | 403 | A2 | | | | | LSD0047.005 | 1.71 |
| 18 | A1 | 403 | A2 | | | | | LSD0048.007 | 1.71 |
| 1656 | A3 | 1900 | A3 | | | | | LSD0046.001 | 1.71 |
| 1656 | A3 | 1900 | A3 | | | | | LSD0046.002 | 1.71 |
| 1656 | A3 | 1905 | A3 | | | | | LSD0046.003 | 1.71 |
| 1711 | A3 | 40 | A1 | | | | | LSD0040.011 | 1.71 |
| 1711 | A3 | 26 | A1 | | | | | LSD0040.042 | 1.71 |
| 1720 | A3 | 26 | A1 | | | | | LSD0040.002 | 1.71 |
| 1720 | A3 | 40 | A1 | | | | | LSD0040.008 | 1.71 |
| 1720 | A3 | 18 | A1 | | | | | LSD0040.021 | 1.71 |
| 1720 | A3 | 26 | A1 | | | | | LSD0040.037 | 1.71 |
| 1720 | A3 | 18 | A1 | | | | | LSD0040.046 | 1.71 |
| 1725 | A3 | 26 | A1 | | | | | LSD0040.003 | 1.71 |
| 1725 | A3 | 40 | A1 | | | | | LSD0040.006 | 1.71 |
| 1725 | A3 | 26 | A1 | | | | | LSD0040.007 | 1.71 |
| 1725 | A3 | 18 | A1 | | | | | LSD0040.010 | 1.71 |
| 1725 | A3 | 40 | A1 | | | | | LSD0040.039 | 1.71 |
| 1725 | A3 | 18 | A1 | | | | | LSD0040.052 | 1.71 |
| 1720 | A3 | 403 | A2 | | | | | LSD0041.001 | 1.71 |
| 1720 | A3 | 399 | A2 | | | | | LSD0041.004 | 1.71 |
| 1711 | A3 | 403 | A2 | | | | | LSD0041.006 | 1.71 |
| 1720 | A3 | 403 | A2 | | | | | LSD0041.008 | 1.71 |
| 1725 | A3 | 403 | A2 | | | | | LSD0041.010 | 1.71 |
| 1725 | A3 | 403 | A2 | | | | | LSD0041.014 | 1.71 |
| 1725 | A3 | 399 | A2 | | | | | LSD0041.016 | 1.71 |
| 1711 | A3 | 403 | A2 | | | | | LSD0041.035 | 1.71 |
| 1900 | A3 | 399 | A2 | | | | | LSD0043.001 | 1.71 |
| 1900 | A3 | 403 | A2 | | | | | LSD0043.002 | 1.71 |
| 1905 | A3 | 403 | A2 | | | | | LSD0043.005 | 1.71 |
| 1900 | A3 | 399 | A2 | | | | | LSD0043.006 | 1.71 |
| 1900 | A3 | 403 | A2 | | | | | LSD0043.007 | 1.71 |
| 1900 | A3 | 403 | A2 | | | | | LSD0043.008 | 1.71 |
| 1905 | A3 | 399 | A2 | | | | | LSD0043.015 | 1.71 |
| 1905 | A3 | 403 | A2 | | | | | LSD0043.029 | 1.71 |
| 1910 | A3 | 403 | A2 | | | | | LSD0043.043 | 1.71 |
| 26 | A1 | 403 | A2 | 1656 | A3 | | | pS0077 | 2.30 |
| 26 | A1 | 403 | A2 | 1720 | A3 | | | pS0078 | 2.30 |
| 26 | A1 | 403 | A2 | 1900 | A3 | | | pS0079 | 2.30 |
| 26 | A1 | 1656 | A3 | 1720 | A3 | | | pS0080 | 2.30 |
| 26 | A1 | 1656 | A3 | 1900 | A3 | | | pS0081 | 2.30 |
| 26 | A1 | 1720 | A3 | 1900 | A3 | | | pS0082 | 2.30 |
| 403 | A2 | 1656 | A3 | 1720 | A3 | | | pS0083 | 2.30 |
| 403 | A2 | 1656 | A3 | 1900 | A3 | | | pS0084 | 2.30 |
| 403 | A2 | 1720 | A3 | 1900 | A3 | | | pS0085 | 2.30 |
| 1656 | A3 | 1720 | A3 | 1900 | A3 | | | pS0086 | 2.30 |
| 26 | A1 | 403 | A2 | 1656 | A3 | 1720 | A3 | pS0087 | 2.83 |
| 26 | A1 | 403 | A2 | 1656 | A3 | 1900 | A3 | pS0088 | 2.83 |
| 26 | A1 | 403 | A2 | 1720 | A3 | 1900 | A3 | pS0089 | 2.83 |
| 26 | A1 | 1656 | A3 | 1720 | A3 | 1900 | A3 | pS0090 | 2.83 |
| 403 | A2 | 1656 | A3 | 1720 | A3 | 1900 | A3 | pS0091 | 2.83 |
| 26 | A1 | 403 | A2 | 1656 | A3 | 1720 | A3 | pS0092 | 2.83 |
| 18 | A1 | 745 | B | 2332 | CT | | | LSD0049.002 | 2.24 |
| 26 | A1 | 745 | B | 2332 | CT | | | LSD0049.008 | 2.24 |
| 26 | A1 | 745 | B | 2332 | CT | | | LSD0049.011 | 2.24 |
| 40 | A1 | 745 | B | 2332 | CT | | | LSD0049.012 | 2.24 |
| 40 | A1 | 745 | B | 2332 | CT | | | LSD0049.020 | 2.24 |
| 18 | A1 | 745 | B | 2332 | CT | | | LSD0049.021 | 2.24 |
| 40 | A1 | 745 | B | 2332 | CT | | | LSD0050.002 | 2.24 |
| 18 | A1 | 745 | B | 2332 | CT | | | LSD0050.003 | 2.24 |
| 26 | A1 | 745 | B | 2332 | CT | | | LSD0050.007 | 2.24 |
| 18 | A1 | 745 | B | 2332 | CT | | | LSD0050.010 | 2.24 |
| 26 | A1 | 745 | B | 2332 | CT | | | LSD0050.012 | 2.24 |
| 40 | A1 | 745 | B | 2332 | CT | | | LSD0050.014 | 2.24 |

TABLE 28-continued

Results of Radii Calculations for CFXTEN comprising XTEN

| Insertion 1 | | Insertion 2 | | Insertion 3 | | Insertion 4 | | | Ratio |
|---|---|---|---|---|---|---|---|---|---|
| Insert Site | Domain | Insert Site | Domain | Insert Site | Domain | Insert Site | Domain | Construct | XTEN Radii |
| 403 | A2 | 745 | B | 2332 | CT | | | LSD0050.002 | 2.24 |
| 399 | A2 | 745 | B | 2332 | CT | | | LSD0050.003 | 2.24 |
| 403 | A2 | 745 | B | 2332 | CT | | | LSD0050.001 | 2.24 |
| 399 | A2 | 745 | B | 2332 | CT | | | LSD0050.003 | 2.24 |
| 1725 | A3 | 745 | B | 2332 | CT | | | LSD0050.021 | 2.24 |
| 1720 | A3 | 745 | B | 2332 | CT | | | LSD0050.022 | 2.24 |
| 1711 | A3 | 745 | B | 2332 | CT | | | LSD0051.024 | 2.24 |
| 1720 | A3 | 745 | B | 2332 | CT | | | LSD0051.021 | 2.24 |
| 1711 | A3 | 745 | B | 2332 | CT | | | LSD0052.025 | 2.24 |
| 1725 | A3 | 745 | B | 2332 | CT | | | LSD0052.026 | 2.24 |

Example 27: Binding Interference of FVIII-XTEN to Anti-FVIII Antibody

The ability of XTEN inserted into different locations of CFXTEN fusion proteins to affect the binding of anti-FVIII antibodies was determined by sandwich ELISA assays. Two anti-FVIII antibodies; i.e. GMA-8021 (Green Mountain Antibodies, Burlington, Vt.) and ESH8 (American Diagnostica Inc., Stamford, Conn.), that bind to the A2 and C2 domains, respectively were utilized as capture antibodies. A non-XTEN containing FVIII-His-Myc protein was used as a calibration standard and positive control for all ELISAs. Ten CFXTEN fusion proteins with single XTEN insertions in either the A1, A2 or A3 domains were created that additionally contained His and Myc affinity tags. The protein concentrations of each test sample was normalized to 100% based on an anti-His capture-anti-Myc detection ELISA run concurrently on the same plate as the anti-FVIII antibody capture-anti-Myc detection ELISA.

Briefly, appropriate wells on a 96-well plate were coated with GMA-8021, ESH8 or anti-His antibody overnight at 4° C., then were washed and blocked with BSA. Equal volumes of the respective control or fusion proteins were introduced into duplicate wells and allowed to interact with coated GMA-8021, ESH8 or anti-His antibody for 2 h at room temperature. After incubation, unbound material was washed away and a rabbit anti-Myc detection antibody was added and incubated for an additional h at room temperature. The plate was then washed and a peroxidase-conjugated donkey anti-rabbit secondary antibody was introduced and incubated for 1 h at room temperature. The plate was washed again, followed by the addition of TMB substrate and the reaction was allowed to proceed for 5-20 min. H2SO4 was introduced to stop the reaction and absorbance was read by spectrophotometer at 450 nm.

Results:

The results are presented in Table 29. Collectively, the results demonstrate that the two antibodies against the CFXTEN fusion proteins with XTEN inserted into the A2 domain exhibited reduced binding of FVIII compared to CFXTEN with XTEN inserted into the A1 or A3 domain when the anti-FVIII capture antibody was GMA-8021 (with binding affinity to the A2 domain). In contrast, there was no discernible pattern of inhibition or enhancement of binding by any of the CFXTEN when the anti-FVIII capture antibody was ESH8, with binding affinity to the C2 domain.

TABLE 29

Binding Interference of FVIII-XTEN to anti-FVIII Antibody

| | XTEN insertion | Concentration on aFVIII/MYc ÷ concentration on aHis/MYc | | |
|---|---|---|---|---|
| Sample Tested | (Domain, site, XTEN) | His/Myc | GMA-8021/Myc (A2 domain) | ESH8/Myc (C2 domain) |
| FVIII-His-Myc | None | 100% | 92% | 104% |
| FVIII-XTEN-His-Myc | A2, 403, AE144 | 100% | 103% ± 1% | 141% ± 24% |
| | A2, 403, AG144 | 100% | 104% ± 6% | 129% ± 12% |
| | A2, 399, AE144 | 100% | 100% ± 8% | 140% ± 18% |
| | A3, 1656, AG144 | 100% | 153% | 158% |
| | A1, 18, AE144 | 100% | 129% | 130% |
| | A1, 18, AG144 | 100% | 150% | 131% |
| | A1, 26, AE144 | 100% | 155% | 87% |
| | A1, 26, AG144 | 100% | 157% | 147% |
| | A1, 40, AE144 | 100% | 137% | 147% |
| | A1, 40, AG144 | 100% | 164% ± 0% | 153% ± 18% | aFVIII/Myc = GMA-8021/Myc or ESH8/Myc antibody condition;
aHis/Myc = anti-His/Myc antibody condition Example 28: Activity Assay of CFXTEN Fusion Proteins in the Presence of FVIII Inhibitors Inhibitor Testing Titration Procedure Select antibodies inhibiting FVIII procoagulant activity were purchased from commercial sources. The antibodies target select domains of FVIII (e.g. A2, A3, C1, C2) and inhibit FVIII-dependent procoagulant activity. In order to establish the optimal concentration of FVIII inhibitors to utilize in the assay, an initial titration experiment was performed using varying amounts of each inhibitory antibody incubated at 37° C. for 2 hrs with the base vector expressing wild-type FVIII with a His/Myc double tag, and a second sample with antibody and at least one CFXTEN fusion protein. The samples were then utilized in a coagulation assay to determine the FVIII activity. The activity was measured by the Coatest assay procedure described herein. The concentration that resulted in optimal inhibition of FVIII activity was determined for each antibody individually.

Inhibitor Testing Procedure:

The FVIII inhibitor antibodies were then used at their optimal concentration for assay of test samples. CFXTEN and positive control samples were individually incubated with each antibody at 37° C. for 2 hrs and the samples were then collected and utilized in the Coatest activity assay, along with untreated aliquots of the CFXTEN and positive control. In some cases, CFXTEN constructs with a R1648A mutation were tested to determine the effect, if any, of this mutation on resistance to inhibitors as measured by the retention of FVIII activity.

Figure 26:
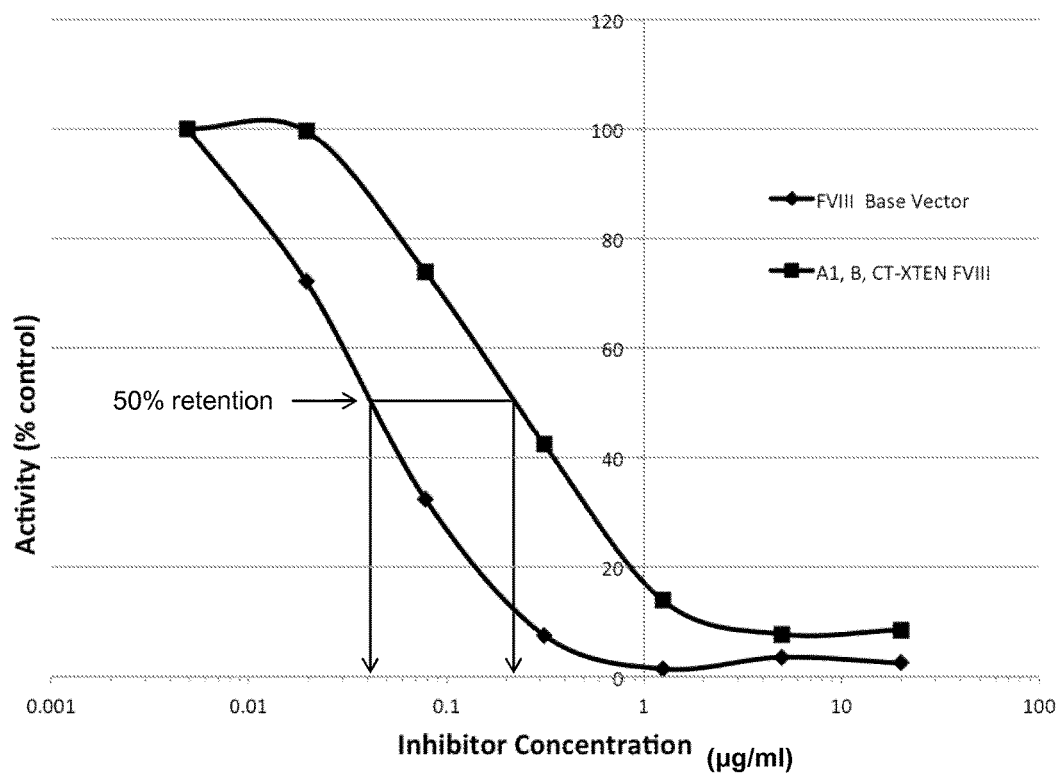
FIG. 26 is a graphic depiction of a titration of GMA8021 FVIII inhibitor using the pBC0114 BDD-FVIII AND CFXTEN construct LSD0049.002 with three 144 amino acid XTEN insertions at residues 18, 745 and 2332. The data indicate a right-shift of approximately 0.7 order of magnitude in the amount of antibody in μg/ml required to inhibit the CFXTEN to the 50% level, compared to FVIII positive control.

Results:

The results of the titration experiment are shown in FIG. 26. The data indicate a right-shift of approximately 0.7 order of magnitude in the amount of antibody required to inhibit the procoagulant activity of the CFXTEN LSD0049.002 to the 50% level, compared to FVIII positive control, indicating that the CFXTEN with three XTEN insertions (at insertion points corresponding to amino acid residue 18, 745 and 2332 of the BDD-FVIII) had lower binding with the antibody compared to FVIII, reflected in the retention of coagulation activity.

The results of the Coatest assays are presented in Tables 30 and 31, for the FVIII inhibitor antibodies GMA8008 and GMA8021, respectively. All of the untreated CFXTEN fusion protein constructs tested exhibited procoagulant activity, as did the pBC00114 FVIII positive control. The positive control sample pre-incubated with FVIII inhibitor antibodies resulted in a sharp decrease in the measured coagulation activity to 0.05-0.15 (5-15%) relative to the untreated sample, as did the majority of the CFXTEN constructs treated with the GMA8008 antibody to the C2 domain. However, three CFXTEN fusion proteins retained at least twice the relative remaining activity compared to the FVIII control; LSD0049.020, LSD0053.024, and LSD0056.025, each with three XTEN inserts.

Figure 29:
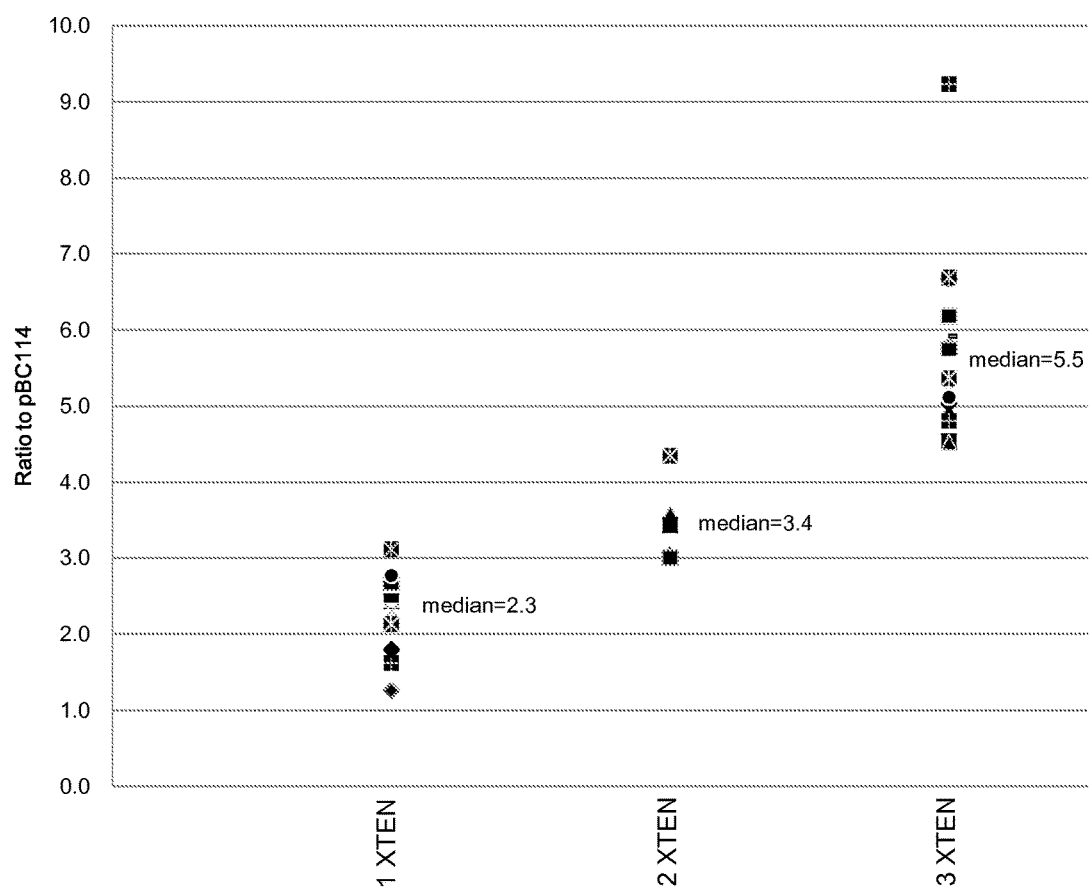
FIG. 29 is a graph of the individual construct values of the ratio of FVIII activity in the assayed CFXTEN to that of the pBC114 FVIII positive control after exposure to the GMA8021 antibody to FVIII, grouped according to the number of XTEN in the construct fusion protein (see Example 28). The results show an essentially linear relationship in the ability of the CFXTEN to retain FVIII activity with increasing number of incorporated XTEN.

The CFXTEN samples showed a lower degree of inhibition with the GMA8021 antibody to the A2 domain compared to untreated samples that was further reduced by either the additional numbers of XTEN inserts (tabular data shown in Table 30). FIG. 29 shows the graph of median values of the ratio to control of retained activity showing a linear relationship between numbers of XTEN inserted and reduced inhibition to the GMA8021 antibody relative to the inhibition of the FVIII control. Similarly, the means±S.E. for the ratio to control values were 2.26+0.12 for 1 XTEN, 3.48+0.26 for 2 XTEN and 5.70+0.29 for 3 XTEN insertions. CFTXEN with at least three XTEN inserts treated with the GMA8021 antibody had at least 4.5 to 9.2-fold greater retention of FVIII activity compared to FVIII control. In addition, in those CFXTEN with three XTEN insertions, constructs with a higher degree of separation (in numbers of amino acid residues) between any two insertions appeared to result in a higher degree of procoagulant activity and, hence, less binding by the FVIII inhibitor antibody, compared to insertions clustered more closely; e.g. on the C-terminal side of the B-domain. The assay results of constructs with the R1648A mutation appeared to be comparable to those without the mutation.

Conclusions:

The results support that, under the conditions of the experiments, insertion of XTEN into FVIII resulted in protection against binding by FVIII inhibitors, with retention of procoagulant activity, and that inclusion of multiple XTEN inserts increased resistance to, in particular, the A2 domain inhibitor antibody. Lastly, there appears to be an effect by having spatial separation between the XTEN inserts.

TABLE 30

Results of Coagulation Assay with CFXTEN treated with antibody GMA8008 to C2 Domain

| Construct Name | Relative Remaining Activity | Ratio to Control | XTEN Insertion 1 | XTEN Insertion 2 | XTEN Insertion 3 | Mutations |
|---|---|---|---|---|---|---|
| pBC0114 CT | 0.05-0.15 | 1 | | | | |
| pBC0149 | 0.1 | 0.8 | 0745_AE42_1 | | | |
| pSD0045 | 0.3 | 1.1 | 0018_AE144_5A | | | |
| pSD0046 | 0.3 | 1.0 | 0018_AG144_F | | | |
| pSD0050 | 0.2 | 0.9 | 0026_AG144_F | | | |
| pSD0051 | 0.3 | 1.3 | 0040_AE144_5A | | | |
| pSD0052 | 0.2 | 1.0 | 0040_AG144_F | | | |
| pSD0001 | 0.2 | 0.9 | 0403_AE144_2A | | | |
| pBC0136 | 0.2 | 1.2 | 0745_AE288_1 | | | |
| pBC0137 | 0.2 | 1.1 | 0745_AE288_1 | | | |
| pSD0013 | 0.1 | 0.9 | 2332_AE144_6B | | | |
| pSD0014 | 0.1 | 0.8 | 2332_AE144_1 | | | |
| pBC0145 | 0.1 | 0.6 | 2332_AE288_1 | | | |
| pSD0019 | 0.1 | 0.5 | 2332_AE288_1 | | | |
| pBC0146 | 0.1 | 0.7 | 2332_AE288_1 | | | |
| pSD0015 | 0.1 | 0.8 | 2332_AE864 | | | |
| LSD0038.008 | 0.1 | 0.9 | 0018_AG144_F | 1656_AG144_C | | |
| LSD0038.013 | 0.1 | 0.6 | 0040_AG144_F | 1656_AG144_C | | |
| LSD003.09 | 0.1 | 0.9 | 0745_AE144_3B | 2332_AE288_1 | | |
| LSD003.06 | 0.0 | 0.8 | 0745_AE144_3B | 2332_AE288_1 | | R1648A |
| LSD0046.001 | 0.0 | 0.6 | 1656_AG144_C | 1900_AG144_C | | |
| PSD077 | 0.1 | 1.0 | 0026_AG144_F | 0403_AE144_2A | 1656_AG144_C | |

TABLE 30-continued

Results of Coagulation Assay with CFXTEN treated with antibody GMA8008 to C2 Domain

| Construct Name | Relative Remaining Activity | Ratio to Control | XTEN Insertion 1 | XTEN Insertion 2 | XTEN Insertion 3 | Mutations |
|---|---|---|---|---|---|---|
| PSD080 | 0.1 | 1.0 | 0026_AG144_F | 1656_AG144_C | 1720_AG144_C | |
| PSD083 | 0.1 | 0.8 | 0403_AG144_2A | 1656_AG144_C | 1720_AG144_C | |
| PSD084 | 0.1 | 0.9 | 0403_AG144_2A | 1656_AG144_C | 1900_AE144_4A | |
| LSD0050.010 | 0.1 | 0.7 | 0018_AE144_5A | 0745_AE144_3B | 2332_AE288_1 | |
| LSD0049.021 | 0.0 | 0.6 | 0018_AE144_5A | 0745_AE144_3B | 2332_AE288_1 | R1648A |
| LSD0049.002 | 0.1 | 0.9 | 0018_AE144_F | 0745_AE144_3B | 2332_AE288_1 | R1648A |
| LSD0049.008 | 0.1 | 0.9 | 0026_AE144_5A | 0745_AE144_3B | 2332_AE288_1 | R1648A |
| LSD0049.011 | 0.1 | 0.9 | 0026_AG144_F | 0745_AE144_3B | 2332_AE288_1 | R1648A |
| LSD0049.020 | 0.2 | 2.6 | 0040_AE144_5A | 0745_AE144_3B | 2332_AE288_1 | R1648A |
| LSD0050.002 | 0.0 | 0.2 | 0040_AG144_F | 0745_AE144_3B | 2332_AE288_1 | |
| LSD0053.024 | 0.2 | 2.5 | 1711_AE144_4A | 0745_AE144_3B | 2332_AE288_1 | |
| LSD0054.021 | 0.2 | 1.5 | 1720_AG144_C | 0745_AE144_3B | 2332_AE288_1 | |
| LSD0055.021 | 0.2 | 1.6 | 1900_AE144_4A | 0745_AE144_3B | 2332_AE288_1 | R1648A |
| LSD0056.021 | 0.2 | 1.6 | 1900_AG144_C | 0745_AE144_3B | 2332_AE288_1 | |
| LSD0056.025 | 0.3 | 2.0 | 1910_AG144_C | 0745_AE144_3B | 2332_AE288_1 | | proportion of activity remaining relative to corresponding untreated sample The ratio of the relative remaining activity (relative to its own control) compared to FVIII pBC0114 positive control

TABLE 31

Results of Coagulation Assay with CFXTEN treated with antibody GMA8021 to A2 Domain

| Construct Name | Relative Remaining Activity | Ratio to Control | XTEN Insertion 1 | XTEN Insertion 2 | XTEN Insertion 3 | Mutation |
|---|---|---|---|---|---|---|
| pBC0114 | 0.05-0.15 | 1 | | | | |
| pBC0149 | 0.2 | 1.3 | 0745_AE42_1 | | | |
| pSD0045 | 0.3 | 2.7 | 0018_AE144_5A | | | |
| pSD0046 | 0.2 | 2.1 | 0018_AG144_F | | | |
| pSD0050 | 0.2 | 2.4 | 0026_AG144_F | | | |
| pSD0051 | 0.3 | 3.1 | 0040_AE144_5A | | | |
| pSD0052 | 0.3 | 2.7 | 0040_AG144_F | | | |
| pSD0001 | 0.2 | 1.6 | 0403_AE144_2A | | | |
| pBC0136 | 0.3 | 2.4 | 0745_AE288_1 | | | |
| pBC0137 | 0.3 | 2.4 | 0745_AE288_1 | | | R1648A |
| pSD0013 | 0.2 | 1.8 | 2332_AE144_6B | | | |
| pSD0014 | 0.2 | 2.1 | 2332_AG144_1 | | | |
| pBC0145 | 0.3 | 2.1 | 2332_AE288_1 | | | |
| pSD0019 | 0.3 | 2.3 | 2332_AE288_1 | | | |
| pBC0146 | 0.3 | 2.1 | 2332_AG288_1 | | | |
| pSD0015 | 0.3 | 2.8 | 2332_AE864 | | | |
| LSD0038.008 | 0.4 | 3.0 | 0018_AG144_F | 1656_AG144_C | | |
| LSD0038.013 | 0.4 | 3.0 | 0040_AG144_F | 1656_AG144_C | | |
| LSD003.09 | 0.3 | 3.6 | 0745_AE144_3B | 2332_AE288_1 | | |
| LSD003.06 | 0.3 | 3.4 | 0745_AE144_3B | 2332_AE288_1 | | R1648A |
| LSD0046.001 | 0.2 | 4.4 | 1656_AG144_C | 1900_AG144_C | | |
| PSD077 | 0.4 | 5.8 | 0026_AG144_F | 0403_AE144_2A | 1656_AG144_C | |
| PSD080 | 0.4 | 5.7 | 0026_AG144_F | 1656_AG144_C | 1720_AG144_C | |
| PSD083 | 0.3 | 5.0 | 0403_AG144_2A | 1656_AG144_C | 1720_AG144_C | |
| PSD084 | 0.3 | 4.5 | 0403_AG144_2A | 1656_AG144_C | 1900_AE144_4A | |
| LSD0050.010 | 0.4 | 6.7 | 0018_AE144_5A | 0745_AE144_3B | 2332_AE288_1 | |
| LSD0049.021 | 0.4 | 6.7 | 0018_AE144_5A | 0745_AE144_3B | 2332_AE288_1 | R1648A |
| LSD0049.002 | 0.5 | 9.2 | 0018_AE144_F | 0745_AE144_3B | 2332_AE288_1 | R1648A |
| LSD0049.008 | 0.4 | 5.9 | 0026_AE144_5A | 0745_AE144_3B | 2332_AE288_1 | R1648A |
| LSD0049.011 | 0.4 | 5.6 | 0026_AG144_F | 0745_AE144_3B | 2332_AE288_1 | R1648A |
| LSD0049.020 | 0.3 | 5.0 | 0040_AE144_5A | 0745_AE144_3B | 2332_AE288_1 | R1648A |
| LSD0050.002 | 0.3 | 6.2 | 0040_AG144_F | 0745_AE144_3B | 2332_AE288_1 | |
| LSD0053.024 | 0.3 | 4.5 | 1711_AE144_4A | 0745_AE144_3B | 2332_AE288_1 | |
| LSD0054.021 | 0.5 | 5.2 | 1720_AG144_C | 0745_AE144_3B | 2332_AE288_1 | |
| LSD0055.021 | 0.5 | 5.4 | 1900_AE144_4A | 0745_AE144_3B | 2332_AE288_1 | R1648A |
| LSD0056.021 | 0.5 | 5.1 | 1900_AG144_C | 0745_AE144_3B | 2332_AE288_1 | |
| LSD0056.025 | 0.5 | 4.8 | 1910_AG144_C | 0745_AE144_3B | 2332_AE288_1 | | proportion of activity remaining relative to corresponding untreated sample The ratio of the relative remaining activity (relative to its own control) compared to FVIII pBC0114 positive control

Example 29: Protein Purification of CFXTEN Fusion Proteins pBC0145 and pBC0146

Two CFXTEN constructs with C-terminal XTEN were utilized to establish a purification method. For both pBC0145 with a C-terminal XTEN of 288 amino acids of the AE family (see sequence in Table 21) and pBC0146 with a C-terminal XTEN of 288 amino acids of the AG family (see sequence in Table 21), a tangential flow filtration (TFF) step was used to buffer exchange the clarified conditioned media from cell culture. Products were then captured using a strong anion exchange chromatography resin, and then further purified using VIIISelect affinity chromatography (GE Healthcare). An additional size exclusion chromatography (GE Healthcare) was applied to FVIII-pBC0146 as a third polish step to remove high molecule weight species. The purity of both fusion proteins was deemed acceptable by HPLC-SEC and was further confirmed by SDS-PAGE analysis of the two CFXTEN constructs showing CFXTEN products at expected sizes. The specific activity of both molecules was comparable to B-domain deleted FVIII, as measured by aPTT coagulation assay and ELISA determination of FVIII concentration.

Example 30: Pharmacokinetics of CFXTEN Fusion Proteins pBC0145 and pBC0146 in HemA and FVIII/VWF DKO Mice Male FVIII knock-out (HemA) mice or FVIII/VWF double knock-out (DKO) mice, 8-12 weeks old, were treated with a single intravenous administration of either recombinant BDD-FVIII, the CFXTEN pBC0145 or pBC0146 fusion purified proteins (from Example 23) at 200 IU/kg dose (n=4/time point). At select time points, blood samples were collected via vena cava sampling. In HemA mice, blood samples were collected at 5 min, 1 4, 8, 16, 20, 24, 32, and 48 hrs post-dosing for rBDD-FVIII, and at 5 min, 8, 16, 24, 32, 48, 55 and 72 hrs post-dosing for pBC0145 and pBC0146 fusion proteins. In the FVIII/VWF DKO mice, blood samples were collected at 5 min, 30 min and 1 hr post-dosing for rBDD-FVIII, and at 5 min, 4, 8, 16 and 24 hr post-dosing for the pBC0145 and pBC0146 fusion proteins. Plasma FVIII activity was measured by FVIII chromogenic assay and the PK profile was analyzed by the WinNonlin program.

Results:

As show in Table 32 and FIG. 24, CFXTEN with the AE C-terminus XTEN insertion (pBC0145) exhibited 1.6-fold and 14.1-fold FVIII half-life (T1/2) extension compared to rBDD FVIII in HemA mice and FVIII/VWF DKO mice, respectively. The CFXTEN with the AG C-terminus XTEN insertion (pBC0146) had 1.4-fold and 14.4-fold extended half-life compared to rBDD-FVIII in the HemA mice and FVIII/VWF DKO mice, respectively. The magnitude of the FVIII half-life extension conferred by XTEN insertion was much more pronounced in the FVIII/VWF DKO mice compared to the HemA mice, demonstrated by the 14-fold longer FVIII half-life from both FVIII-AE-XTEN and FVIII-AG-XTEN compared to rBDD-FVIII. In addition, in comparison to rBDD-FVIII, FVIII with C-terminal AE or AG-XTEN insertion also had significantly improved FVIII recovery at the 5 min interval, reduced clearance and volume of distribution, and increased AUC in the DKO mice. Under the conditions of the experiment, CFXTEN with C-terminus XTEN insertions demonstrated great potential on FVIII half-life extension, and, when combined with other FVIII intra-domain insertions could potentially further extend FVIII half-life.

TABLE 32

Pharmacokinetic parameters of CFXTEN in HemA and FVIII/VWF DKO mice

| Mouse Strain | Treatment | 5 min Recovery (%) | $T_{1/2}$ (hr) | MRT (hr) | Cl (mL/hr/kg) | Vss (mL/kg) | AUC_D (hrkgmIU/mL/mIU) | $T_{1/2}$ Fold Increase | Mouse Strain |
|---|---|---|---|---|---|---|---|---|---|
| HemA | pBC0145 | 73 | 11.88 | 16.47 | 3.81 | 62.74 | 0.26 | 1.6 | HemA |
| | pBC0146 | 64 | 10.54 | 13.31 | 5.66 | 75.34 | 0.18 | 1.4 | |
| | rBDD-FVIII | 89 | 7.58 | 11.02 | 4.33 | 47.68 | 0.23 | | |
| FVIII/VWF DKO | pBC0145 | 74 | 3.38 | 3.76 | 13.06 | 63.68 | 0.0765 | 13.9 | FVIII/VWF DKO |
| | pBCF0146 | 61 | 3.45 | 3.61 | 17.40 | 86.63 | 0.0575 | 14.2 | |
| | rBDD-FVIII | 23 | 0.24 | 0.24 | 460.62 | 161.51 | 0.0022 | | |

Compared to rBDD-FVIII

Example 31: Cell Culture and Concentration of Cell Culture Media for CFXTEN Fusion Proteins pSD0050 and pSD0062

CFXTEN construct variants pSD0050 with an intradomain AG XTEN of 144 amino acids inserted after amino acid residue 26 of BDD FVIII, pSD0062 with an intradomain AE XTEN of 144 amino acids inserted after residue 1900 of BDD FVIII (Note: amino acid numbering based full length FVIII), as well as a construct encoding rBDD-FVIII, were transfected into HEK293F cells (Invitrogen, Carlsbad, Calif.) using polyethyleneimine (PEI, Polysciences Inc. Warrington, Pa.). The transiently transfected cells were grown in 293 Free Style medium media (Invitrogen, Carlsbad, Calif.) for 4 days and 50-100 ml cell culture media were then concentrated 10- to 20-fold by Centricon Spin Column (100 kDa MW cut-off) to reach 10-30 IU/ml FVIII activity. The concentrated materials were then flash-frozen and stored at −80° C. for future in vitro analysis and in vivo pharmacokinetic studies.

Example 32: Pharmacokinetics of CFXTEN Fusion Proteins pSD0050 and pSD0062 in HemA and FVIII/VWF DKO Mice Male HemA or FVIII/VWF double knock-out (DKO) mice, 8-12 weeks old, were treated with a single intravenous administration of cell culture concentrates from Example 31 containing either recombinant BDD-FVIII, the CFXTEN pBD0050 or pBD062 at 100-300 IU/kg (n=3/group). At select time points, blood samples were collected via retro orbital bleeds from the same set of mice. In HemA mice, blood samples were collected at 5 min, 24 hr and 48 hr post-dosing, while in FVIII/VWF DKO mice blood samples were collected at 5 min, 8 hr and 16 hr. The FVIII activity of plasma samples and cell culture concentrates were analyzed by a FVIII chromogenic assay, and the PK profile of rBDD FVIII and FVIII-XTEN variants were analyzed using the WinNonlin program.

Results:

The PK profiles of the two CFXTEN intradomain insertion variants pSD0050 and pSD0062 and rBDD-FVIII in HemA mice and FVIII/VWF DKO mice are shown in FIG. 25 and Table 33. In HemA mice, a comparable initial recovery at the 5 min interval was observed for the three test FVIII molecules. Both CFXTEN fusion proteins demonstrated two-fold longer half-life compared to wild-type BDD-FVIII. In FVIII-VWF DKO mice, because of the loss of VWF protection, rBDD-FVIII had only a 15 min plasma half-life. In the case of the two CFXTEN, however, half-life were extended to 3.15 hr and 3.83 hr, respectively; values that are comparable to the CFXTEN with 288 C-terminus XTEN insertions (Example 24), suggesting that further extension of the XTEN length at a given insertion point may not be necessary. Under the experimental conditions, the study results clearly demonstrate that intradomain insertion of an XTEN with 144 amino acid residues not only preserved FVIII activity, but also provided similar FVIII half-life benefit as the C-terminus 288 amino acid XTEN insertion variants, suggesting that the combination of the FVIII intradomain and C-terminus insertions may allow further extension of FVIII half-life.

parameters. Results are expected to show increased terminal half-life and area under the curve, and a reduced volume of distribution for the CFXEN compared to FVIII alone, and the results are used in conjunction with results from coagulation and pharmacodynamic assays to select those fusion protein configurations with desired properties.

Example 34: Analysis of FVIII for XTEN Insertion Sites

The selection of XTEN insertion sites within the factor VIII molecule was performed by predicting the locations of permissive sites within loop structures or otherwise flexible surface exposed structural elements. For these analyses, the atomic coordinates of two independently determined X-ray crystallographic structures of FVIII were use (Shen B W, et al. The tertiary structure and domain organization of coagulation factor VIII. Blood. (2008) February 1; 111(3):1240-1247; Ngo J C, et al. Crystal structure of human factor VIII: implications for the formation of the factor IXa-factor VIIIa complex. Structure (2008) 16 (4):597-606), as well as those of factor VIII and factor VIIIa derived from molecular dynamic simulation (MDS) (Venkateswarlu, D. Structural investigation of zymogenic and activated forms of human blood coagulation factor VIII: a computational molecular dynamics study. BMC Struct Biol. (2010) 10:7). Atomic coordinates in Protein Data Bank (PDB) format were analyzed to identify regions of the FVIII/FVIIIa predicted to have a high degree solvent accessible surface area using the algorithms ASAView (Ahmad S, et al. ASAView: database and tool for solvent accessibility representation in proteins. BMC Bioinformatics (2004) 5:51) and GetArea (Rychkov G, Petukhov M. Joint neighbors approximation of macromolecular solvent accessible surface area. J Comput Chem (2007) 28(12):1974-1989). The resulting set of sites was

TABLE 33

Pharmacokinetic parameters of CFXTEN in HemA and FVIII/VWF DKO mice

| Mouse Strain | Treatment | 5 min Recovery (%) | $T_{1/2}$ (hr) | MRT (hr) | Cl (mL/hr/kg) | Vss (mL/kg) | AUC_D (hr·kg·mIU/mL/mIU) | $T_{1/2}$ Fold Increase |
|---|---|---|---|---|---|---|---|---|
| HemA | pSD0050 | 40 | 14.12 | 14.25 | 5.27 | 75.03 | 0.19 | 2.3 |
| | pSD0062 | 43 | 12.96 | 14.79 | 4.24 | 62.67 | 0.24 | 2.1 |
| | rBDD-FVIII | 47 | 6.19 | 2.62 | 6.35 | 16.62 | 0.16 | |
| FVIII/ VWF DKO | pSD0050 | 34 | 3.15 | 2.59 | 21.73 | 56.28 | 0.05 | ~12 |
| | pSD0062 | 35 | 3.83 | 3.71 | 18.51 | 68.69 | 0.05 | ~15 |
| | rBDD-FVIII | 23 | ~0.25 | | | | | |

Compared to rBDD-FVIII

Example 33: Pharmacokinetic Analysis of CFXTEN Fusion Polypeptides in Rats

The pharmacokinetics of various CFXTEN fusion proteins, compared to FVIII alone, are tested in Sprague-Dawley rats. CFXTEN and FVIII are administered to female Sprague-Dawley rats (n=3) IV through a jugular vein catheter at 3-10 g/rat. Blood samples (0.2 mL) are collected into pre-chilled heparinized tubes at predose, 0.08, 0.5, 1, 2, 4, 8, 24, 48, 72 hour time points, and processed into plasma. Quantitation of the test articles is performed by ELISA assay using an anti-FVIII antibody for both capture and detection. A non-compartmental analysis is performed in WinNonLin with all time points included in the fit to determine the PK then further prioritized on the basis of high predicted atomic positional fluctuation based on the basis of the published results of the MDS study. Sites within the acidic peptide regions flanking the A1, A2, and A3 domains, as well as those that appeared by visual inspection to be in areas other than surface exposed loops were deprioritized. The resulting set of potential sites was evaluated on the basis of interspecies sequence conservation, with those sites in regions of high sequence conservation among 20 vertebrate species being ranked more favorably. Additionally, putative clearance receptor binding sites, FVIII interaction sites with other molecules (such as vWF, FIX), domain and exon boundaries were also considered in fusion site selection. Finally, sites within close proximity to mutations implicated in hemophilia A listed in the Haemophilia A Mutation, Search, Test and Resource Site (HAMSTeRS) database were eliminated (Kemball-Cook G, et al. The factor VIII Structure and Mutation Resource Site: HAMSTeRS version 4. Nucleic Acids Res. (1998) 26(1):216-219). Based on these criteria, the construction of 42 FVIII-XTEN variants was proposed for XTEN insertions. Of these, three represent XTEN insertions within the residual B domain sequence, two represent extensions to the C-terminus of the factor VIII molecule, and 37 represent XTEN insertions within structurally defined inter- and intradomain structural elements; i.e., residues 3, 18, 22, 26, 40, 60, 116, 130, 188, 216, 230, 333, 375, 403, 442, 490, 518, 599, 713, 745, 1720, 1796, 1802, 1827, 1861, 1896, 1900, 1904, 1937, 2019, 2068, 2111, 2120, 2171, 2188, 2227, 2277, and 2332.

Example 35: Functional Analysis of FVIII-XTEN Constructs

Two FVIII-XTEN fusion proteins, FVIII-AE288 (F8X-40) and FVIII-AG288 (F8X-41), contain an AE288_1 XTEN or an AG288_1 XTEN, respectively, fused at the C-terminus of FVIII C2 domain. To determine if FVIII activity was retained after XTEN fusion, HEK293 cells were transfected separately with these two FVIII-XTEN fusion constructs by using polyethylenimine (PEI) in serum-free medium. At 3 or 5 days post-transfection, the cell culture supernatant was tested for FVIII activity by a two-stage chromogenic assay. Purified recombinant FVIII, calibrated against WHO international standard, was used to establish the standard curve in the chromogeinic assay. The fusion protein products of both F8X-40 and F8X-41 constructs were expressed at levels comparable to those of wild-type BDD-FVIII constructs. (Table 34).

TABLE 34

FVIII Titer of FVIII-XTEN fusion proteins in transient transfection cell culture

| FVIII Molecules | | FVIII 066[a] | pBC 0114[a] | F8X-40 | F8X-41 |
|---|---|---|---|---|---|
| FVIII activity (IU/ml) | Sample A | 6.42 | 6.68 | 7.47 | 3.32[b] |
| | Sample B | 7.13 | 7.61 | 8.25 | Not done |

[a]Both FVIII 066 and pBC 0114 contain B-domain deleted FVIII without XTEN fusion.
[b]The F8X-41 sample was from a 3-day transfection while other samples were from a 5-day transient transfection.

Figure 23:
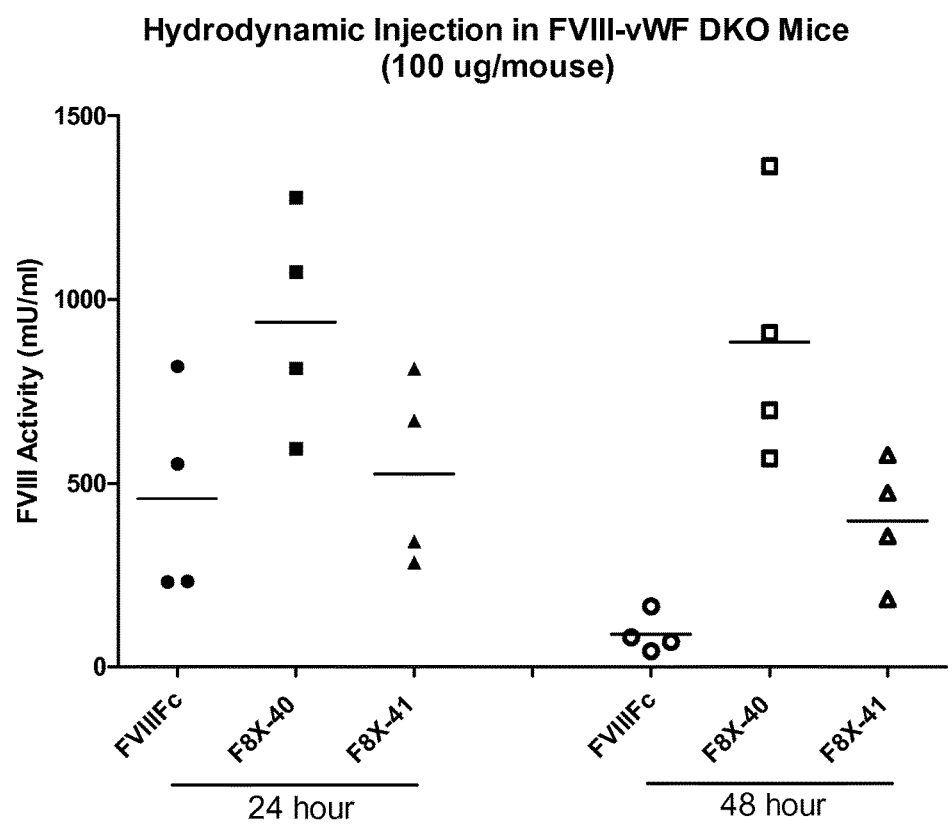
FIG. 23 shows the results of FVIII assay on samples obtained from FVIII and von Willebrand factor double knock-out mice with hydrodynamic plasmid DNA injection, as detailed in Example 36.

Example 36: Functional Analysis of FVIII-XTEN Constructs: FVIII Activity and PK Properties The half-life extension potential of the F8X-40 and F8X-41 constructs was evaluated in FVIII and von Willebrand factor double knock-out mice by hydrodynamic plasmid DNA injection, with a FVIIIFc DNA construct serving as a positive control. Mice were randomly divided into 3 groups with 4 mice per group. Plasmid DNA encoding BDD FVIIIFc fusion protein, F8X-40 or F8X-41, all sharing the same DNA vector backbone, was administered to mice in the respective groups. Approximately 100 micrograms of the appropriate plasmid DNA was injected into each mouse via hydrodynamic injection, and blood plasma samples were collected at 24 hours and 48 hours post-injection. The plasma FVIII activity was measured by a two-stage chromogenic assay using calibrated recombinant FVIII as a standard. As shown in FIG. 23, samples from the F8X-40 and F8X-41 groups showed higher plasma FVIII titers than did those from the BDD FVIIIFc, suggesting FVIII fusion with XTEN prolongs the half-life of FVIII in vivo. Taken together, these data support the conclusion that FVIII-XTEN fusion proteins retained FVIII activity in transient transfection and exhibited prolonged circulating half-life in an animal model.

Example 37: Pharmacodynamic Evaluation of CFXTEN in Animal Models

The in vivo pharmacologic activity of CFXTEN fusion proteins are assessed using a variety of preclinical models of bleeding including but not limited to those of hemophilia, surgery, trauma, thrombocytopenia/platelet dysfunction, clopidogrel/heparin-induced bleeding and hydrodynamic injection. These models are developed in multiple species including mice, rat, rabbits, and dogs using methods equivalent to those used and published for other FVIII approaches. CFXTEN compositions are provided in an aqueous buffer compatible with in vivo administration (for example: phosphate-buffered saline or Tris-buffered saline). The compositions are administered at appropriate doses, dosing frequency, dosing schedule and route of administration as optimized for the particular model. Efficacy determinations include measurement of FVIII activity, one-stage clotting assay, FVIII chromogenic assay, activated partial prothrombin time (aPTT), bleeding time, whole blood clotting time (WBCT), thrombelastography (TEG or ROTEM), among others.

In one example of a PD model, CFXTEN and FVIII are administered to genetically-deficient or experimentally-induced HemA mice. At various time points post-administration, levels of FVIII and CFXTEN are measured by ELISA, activity of FVIII and CFXTEN is measured by commercially-available FVIII activity kits and clotting time is measured by aPTT assay. Overall, the results can indicate that the CFXTEN constructs may be more efficacious at inhibiting bleeding as compared to FVIII and/or equivalent in potency to comparable dosage of FVIII with less frequent or more convenient dosing intervals.

In a mouse bleeding challenge PD model CFXTEN and FVIII are administered to genetically-deficient or experimentally-induced HemA mice and effect on hemostatic challenge is measured. Hemostatic challenge can include tail transaction challenge, hemarthropthy challenge, joint bleeding or saphenous vein challenge among others. At various time points post-administration levels of FVIII and CFXTEN are measured by ELISA, activity of FVIII and CFXTEN are measured by commercially available FVIII activity kit, bleeding time is measured and clotting time is measured by aPTT assay. Overall the results are expected to indicate that the CFXTEN constructs are more efficacious at inhibiting bleeding as compared to FVIII and/or equivalent in potency to comparable dosage of FVIII with less frequent or more convenient dosing intervals, and the results are used in conjunction with results from coagulation and other assays to select those fusion protein configurations with desired properties.

In a dog PD model, CFXTEN and FVIII are administered to genetically-deficient hemophiliac dogs. At various time points post administration, levels of FVIII and CFXTEN are measured by ELISA, activity of FVIII and CFXTEN are measured by commercially available FVIII activity kit and clotting time is measured by aPTT assay. Overall the results indicates that the CFXTEN constructs may be more efficacious at inhibiting bleeding as compared to FVIII and/or equivalent in potency to comparable dosage of FVIII with less frequent or more convenient dosing, and the results are used in conjunction with results from coagulation and other assays to select those fusion protein configurations with desired properties.

In a dog bleeding challenge PD model CFXTEN and FVIII are administered to genetically deficient hemophiliac dogs and effect on hemostatic challenge is measured. Hemostatic challenge includes cuticle bleeding time among others. At various time points post-administration levels of FVIII and CFXTEN are measured by ELISA, activity of FVIII and CFXTEN are measured by commercially available FVIII activity kit, bleeding time is measured and clotting time are measured by aPTT assay. Overall the results indicate that the CFXTEN constructs may be more efficacious at inhibiting bleeding as compared to FVIII and/or equivalent in potency to comparable dosage of FVIII with less frequent or more convenient dosing intervals, and the results are used in conjunction with results from coagulation and other assays to select those fusion protein configurations with desired properties.

Additional preclinical models of bleeding include but are not limited to those of hemophilia, surgery, trauma, thrombocytopenia/platelet dysfunction, clopidogrel/heparin-induced bleeding and hydrodynamic injection. These models can developed in multiple species including mice, rat, rabbits, and dogs using methods equivalent to those used and published for other FVIII approaches. Overall the results indicate that the CFXTEN constructs may be more efficacious at inhibiting bleeding as compared to FVIII and/or equivalent in potency to comparable dosage of FVIII with less frequent or more convenient dosing intervals, and the results are used in conjunction with results from coagulation and other assays to select those fusion protein configurations with desired properties.

Example 38: CFXTEN with Cleavage Sequences

C-Terminal XTEN Releasable by FXIa

A CFXTEN fusion protein consisting of an XTEN protein fused to the C-terminus of FVIII is created with an XTEN release site cleavage sequence placed in between the FVIII and XTEN components, as depicted in FIG. 12. Exemplary sequences are provided in Table 51. In this case, the release site cleavage sequence is incorporated into the CFXTEN that contains an amino acid sequence that is recognized and cleaved by the FXIa protease (EC 3.4.21.27, Uniprot P03951). Specifically the amino acid sequence KLTRAET (SEQ ID NO: 1688) is cut after the arginine of the sequence by FXIa protease. FXI is the procoagulant protease located immediately before FVIII in the intrinsic or contact activated coagulation pathway. Active FXIa is produced from FXI by proteolytic cleavage of the zymogen by FXIIa. Production of FXIa is tightly controlled and only occurs when coagulation is necessary for proper hemostasis. Therefore, by incorporation of the KLTRAET cleavage sequence (SEQ ID NO: 1688), the XTEN domain is only be removed from FVIII concurrent with activation of the intrinsic coagulation pathway and when coagulation is required physiologically. This creates a situation where the CFXTEN fusion protein is processed in one additional manner during the activation of the intrinsic pathway.

C-Terminal XTEN Releasable by FIIa (Thrombin)

A CFXTEN fusion protein consisting of an XTEN protein fused to the C-terminus of FVIII is created with an XTEN release site cleavage sequence placed in between the FVIII and XTEN components, as depicted in FIG. 12. In this case, the release site contains an amino acid sequence that is recognized and cleaved by the FIIa protease (EC 3.4.21.5, Uniprot P00734). Specifically the sequence LTPRSLLV (SEQ ID NO: 1618) [Rawlings N. D., et al. (2008) Nucleic Acids Res., 36: D320], is cut after the arginine at position 4 in the sequence. Active FIIa is produced by cleavage of FII by FXa in the presence of phospholipids and calcium and is down stream from factor IX in the coagulation pathway. Once activated its natural role in coagulation is to cleave fibrinogen (FIG. 2), which then in turn, begins clot formation. FIIa activity is tightly controlled and only occurs when coagulation is necessary for proper hemostasis. Therefore, by incorporation of the LTPRSLLV sequence (SEQ ID NO: 1618), the XTEN domain is only removed from FVIII concurrent with activation of either the extrinsic or intrinsic coagulation pathways, and when coagulation is required physiologically. This creates a situation where CFXTEN fusion is processed in one additional manner during the activation of coagulation.

C-Terminal XTEN Releasable by Elastase-2

A CFXTEN fusion protein consisting of an XTEN protein fused to the C-terminus of FVIII is created with an XTEN release site cleavage sequence placed in between the FVIII and XTEN components, as depicted in FIG. 12. Exemplary sequences are provided in Table 51. In this case, the release site contains an amino acid sequence that is recognized and cleaved by the elastase-2 protease (EC 3.4.21.37, Uniprot P08246). Specifically the sequence LGPVSGVP (SEQ ID NO: 1689) [Rawlings N. D., et al. (2008) Nucleic Acids Res., 36: D320], is cut after position 4 in the sequence. Elastase is constitutively expressed by neutrophils and is present at all times in the circulation. Its activity is tightly controlled by serpins and is therefore minimally active most of the time. Therefore as the long lived CFXTEN circulates, a fraction of it is cleaved, creating a pool of shorter-lived FVIII to be used in coagulation. In a desirable feature of the inventive composition, this creates a circulating pro-drug depot that constantly releases a prophylactic amount of FVIII.

C-Terminal XTEN Releasable by MMP-12

A CFXTEN fusion protein consisting of an XTEN protein fused to the C-terminus of FVIII is created with an XTEN release site cleavage sequence placed in between the FVIII and XTEN components, as depicted in FIG. 12. Exemplary sequences are provided in Table 51. In this case, the release site contains an amino acid sequence that is recognized and cleaved by the MMP-12 protease (EC 3.4.24.65, Uniprot P39900). Specifically the sequence GPAGLGGA (SEQ ID NO: 1690) [Rawlings N. D., et al. (2008) Nucleic Acids Res., 36: D320], is cut after position 4 of the sequence. MMP-12 is constitutively expressed in whole blood. Therefore as the long lived CFXTEN circulates, a fraction of it is cleaved, creating a pool of shorter-lived FVIII to be used in coagulation. In a desirable feature of the inventive composition, this creates a circulating pro-drug depot that constantly releases a prophylactic amount of FVIII.

C-Terminal XTEN Releasable by MMP-13

A CFXTEN fusion protein consisting of an XTEN protein fused to the C-terminus of FVIII is created with an XTEN release site cleavage sequence placed in between the FVIII and XTEN components, as depicted in FIG. 12. Exemplary sequences are provided in Table 51. In this case, the release site contains an amino acid sequence that is recognized and cleaved by the MMP-13 protease (EC 3.4.24.-, Uniprot P45452). Specifically the sequence GPAGLRGA (SEQ ID NO: 1691) [Rawlings N. D., et al. (2008) Nucleic Acids Res., 36: D320], is cut after position 4. MMP-13 is constitutively expressed in whole blood. Therefore as the long lived CFXTEN circulates, a fraction of it is cleaved, creating a pool of shorter-lived FVIII to be used in coagulation. In a desirable feature of the inventive composition, this creates a circulating pro-drug depot that constantly releases a prophylactic amount of FVIII.

C-Terminal XTEN Releasable by MMP-17

A CFXTEN fusion protein consisting of an XTEN protein fused to the C-terminus of FVIII is created with an XTEN release site cleavage sequence placed in between the FVIII and XTEN components, as depicted in FIG. 12. Exemplary sequences are provided in Table 51. In this case, the release site contains an amino acid sequence that is recognized and cleaved by the MMP-20 protease (EC.3.4.24.-, Uniprot Q9ULZ9). Specifically the sequence APLGLRLR (SEQ ID NO: 1692) [Rawlings N. D., et al. (2008) *Nucleic Acids Res.*, 36: D320], is cut after position 4 in the sequence. MMP-17 is constitutively expressed in whole blood. Therefore as the long lived CFXTEN circulates, a fraction of it is cleaved, creating a pool of shorter-lived FVIII to be used in coagulation. In a desirable feature of the inventive composition, this creates a circulating pro-drug depot that constantly releases a prophylactic amount of FVIII.

C-Terminal XTEN Releasable by MMP-20

A CFXTEN fusion protein consisting of an XTEN protein fused to the C-terminus of FVIII is created with an XTEN release site cleavage sequence placed in between the FVIII and XTEN components, as depicted in FIG. 12. Exemplary sequences are provided in Table 51. In this case, the release site contains an amino acid sequence that is recognized and cleaved by the MMP-20 protease (EC.3.4.24.-, Uniprot O60882). Specifically the sequence PALPLVAQ (SEQ ID NO: 1693) [Rawlings N. D., et al. (2008) *Nucleic Acids Res.*, 36: D320], is cut after position 4 (depicted by the arrow). MMP-20 is constitutively expressed in whole blood. Therefore as the long lived CFXTEN circulates, a fraction of it is cleaved, creating a pool of shorter-lived FVIII to be used in coagulation. In a desirable feature of the inventive composition, this creates a circulating pro-drug depot that constantly releases a prophylactic amount of FVIII.

Optimization of the Release Rate of XTEN

Variants of the foregoing Examples can be created in which the release rate of XTEN incorporated at the C-terminus, the N-terminus, or internal XTEN is altered. As the rate of XTEN release by an XTEN release protease is dependent on the sequence of the XTEN release site, by varying the amino acid sequence in the XTEN release site one can control the rate of XTEN release. The sequence specificity of many proteases is well known in the art, and is documented in several data bases. In this case, the amino acid specificity of proteases is mapped using combinatorial libraries of substrates [Harris, J. L., et al. (2000) *Proc Natl Acad Sci USA*, 97: 7754] or by following the cleavage of substrate mixtures as illustrated in [Schellenberger, V., et al. (1993) *Biochemistry*, 32: 4344]. An alternative is the identification of optimal protease cleavage sequences by phage display [Matthews, D., et al. (1993) *Science*, 260: 1113]. Constructs are made with variant sequences and assayed for XTEN release using standard assays for detection of the XTEN polypeptides.

Example 39: Human Clinical Trial Designs for Evaluating CFXTEN Comprising FVIII

Kogenate® FS is recombinant human coagulation factor VIII, intended for promoting hemostasis in hemophilia A subjects. Due to its short half-life, Kogenate is dosed intravenously every other day for prophylaxis and 8 to every 12 h in treatment of bleeds until hemostasis is achieved. It is believed that fusion of one or more XTEN to FVIII improves the half-life of the protein, enabling a reduced dosing frequency using such CFXTEN-containing fusion protein compositions.

Clinical trials are designed such that the efficacy and advantages of CFXTEN, relative to Kogenate or other commercially available FVIII preparations, can be verified in humans. Such studies comprises three phases. First, a Phase I safety and pharmacokinetics study in adult patients is conducted to determine the maximum tolerated dose and pharmacokinetics and pharmacodynamics in humans (either normal subjects or patients with hemophilia), as well as to define potential toxicities and adverse events to be tracked in future studies. The Phase I studies are conducted in which single rising doses of CFXTEN compositions are administered by the route (e.g., subcutaneous, intramuscular, or intravenously) and biochemical, PK, and clinical parameters are measured at defined intervals. This permits the determination of the minimum effective dose and the maximum tolerated dose and establishes the threshold and maximum concentrations in dosage and circulating drug that constitute the therapeutic window for the respective components, as well as bioavailability when administered by the intramuscular or subcutaneous routes. From this information, the dose and dose schedule that permits less frequent administration of the CFXTEN compositions, yet retains the pharmacologic response, is obtained. Thereafter, clinical trials are conducted in patients with the condition, verifying the effectiveness of the CFXTEN compositions under the dose conditions, which can be conducted in comparison to a positive control such as Kogenate to establish the enhanced properties of the CFXTEN compositions.

Phase II and III clinical trials are conducted in patients suffering from any disease in which factor VIII may be expected to provide clinical benefit. For example, the CFXTEN is used in clinical trials for treatment of indications approved for use of factor VIII; such indications include bleeding episodes in hemophilia A, patients with inhibitors to factor VIII, prevention of bleeding in surgical interventions or invasive procedures in hemophilia A patients with inhibitors to factor VIII, treatment of bleeding episodes in patients with congenital factor VIII deficiency, and prevention of bleeding in surgical interventions or invasive procedures in patients with congenital factor VIII deficiency. CFXTEN may also be indicated for use in additional patient populations. A phase II dosing study is conducted in hemophilia A patients where pharmacodynamic, coagulation, bleeding and other physiologic, PK, safety and clinical parameters and clinical endpoints appropriate for trials are measured as a function of the dosing of the fusion proteins compositions, yielding dose-ranging information on doses that is appropriate for a subsequent Phase III trial, in addition to collecting safety data related to adverse events. The PK parameters are correlated to the physiologic, clinical and safety parameter data to establish the therapeutic window and the therapeutic dose regimen for the CFXTEN composition, permitting the clinician to establish the appropriate dose ranges for the composition. In one trial, hemophilia A patients with factor VIII inhibitors would be evaluated to establish doses and dose regimen of CFXTEN pharmaceutical compositions that result in achieving and maintaining hemostasis and preventing or attenuating bleeding episodes. Finally, a phase III efficacy study is conducted wherein patients are administered the CFXTEN pharmaceutical composition and a positive control (such as a commercially-available Kogenate) are administered using a dosing schedule deemed appropriate given the pharmacokinetic and pharmacodynamic properties of the respective compositions derived from the Phase II findings, with all agents administered for an appropriately extended period of time to achieve the study endpoints. Parameters that are monitored include aPTT assay, one- or two-stage clotting assays, control of bleeding episodes, or the occurrence of spontaneous bleeding episodes; parameters that are tracked relative to the placebo or positive control groups. Efficacy outcomes are determined using standard statistical methods. Toxicity and adverse event markers are also be followed in this study to verify that the compound is safe when used in the manner described. In another phase III trial, hemophilia A patients with factor VIII inhibitors would be evaluated to establish the effectiveness of CFXTEN pharmaceutical compositions in achieving and maintaining hemostasis and preventing or attenuating bleeding episodes.

Figure 21:
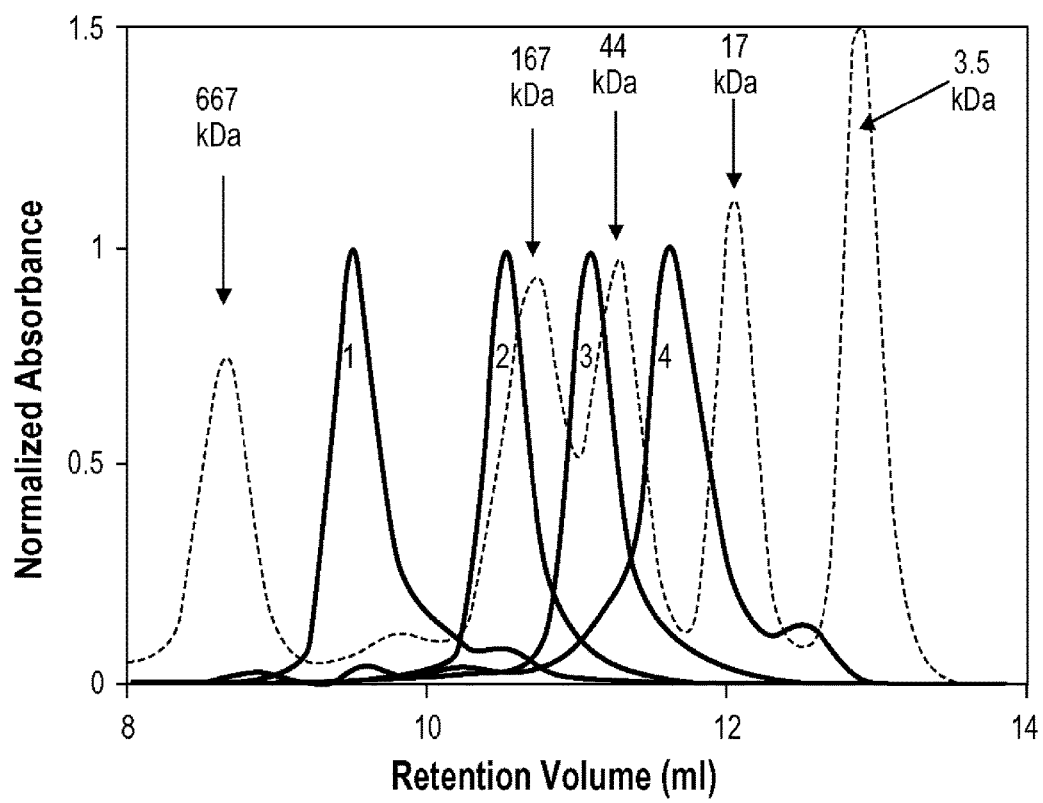
FIG. 21 shows results of a size exclusion chromatography analysis of glucagon-XTEN construct samples measured against protein standards of known molecular weight, with the graph output as absorbance versus retention volume, as described in Example 40. The glucagon-XTEN constructs are 1) glucagon-Y288; 2) glucagonY-144; 3) glucagon-Y72; and 4) glucagon-Y36. The results indicate an increase in apparent molecular weight with increasing length of XTEN moiety (see Example 40 for data).

Example 40: Analytical Size Exclusion Chromatography of XTEN Fusion Proteins with Diverse Payloads Size exclusion chromatography analyses were performed on fusion proteins containing various therapeutic proteins and unstructured recombinant proteins of increasing length. An exemplary assay used a TSKGel-G4000 SWXL (7.8 mm×30 cm) column in which 40 μg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm. Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 21. The data show that the apparent molecular weight of each compound is proportional to the length of the attached XTEN sequence. However, the data also show that the apparent molecular weight of each construct is significantly larger than that expected for a globular protein (as shown by comparison to the standard proteins run in the same assay). Based on the SEC analyses for all constructs evaluated, including a CFXTEN composition, the apparent molecular weights, the apparent molecular weight factor (expressed as the ratio of apparent molecular weight to the calculated molecular weight) and the hydrodynamic radius ($R_H$ in nm) are shown in Table 35. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater, well beyond the glomerular pore size of approximately 3-5 nm. Accordingly, it is expected that fusion proteins comprising growth and XTEN have reduced renal clearance, contributing to increased terminal half-life and improving the therapeutic or biologic effect relative to a corresponding un-fused biologic payload protein.

TABLE 35

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
| --- | --- | --- | --- | --- | --- | --- |
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC398 | AE288 | FVII | 76.3 | 650 | 8.5 | 8.2 |
| AC404 | AE864 | FVII | 129 | 1900 | 14.7 | 10.1 |
| AC85 | AE864 | Exendin-4 | 83.6 | 938 | 11.2 | 8.9 |
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1318 | IL-1ra | 134.8 | 2286 | 17.0 | 10.5 |

Figure 19:
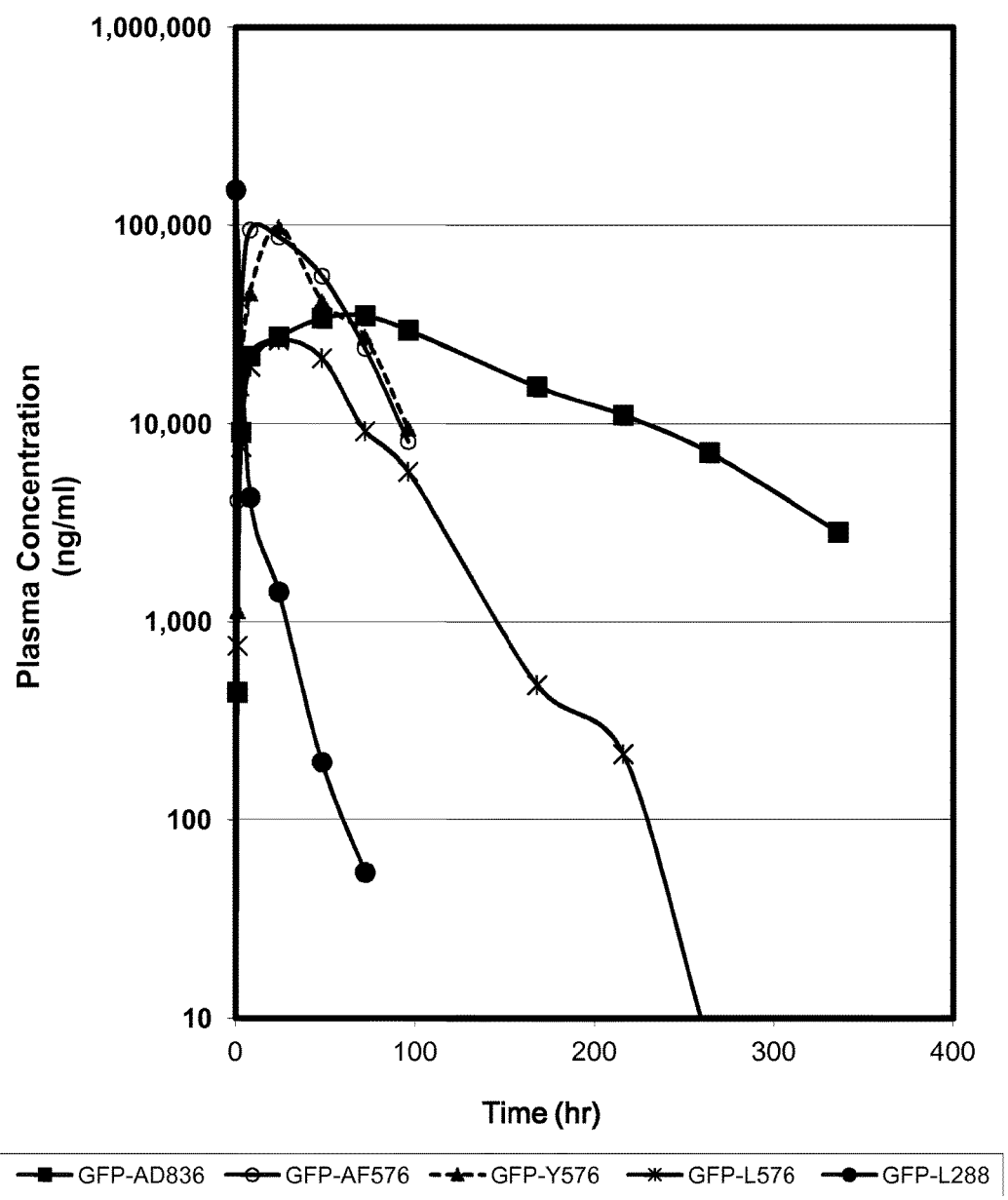
FIG. 19 shows the pharmacokinetic profile (plasma concentrations) in cynomolgus monkeys after single doses of different compositions of GFP linked to unstructured polypeptides of varying length, administered either subcutaneously or intravenously, as described in Example 41. The compositions were GFP-L288, GFP-L576, GFP-XTEN_AF576, GFP-Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

Example 41: Pharmacokinetics of Extended Polypeptides Fused to GFP in Cynomolgus Monkeys The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 19. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 42: Serum Stability of XTEN

Figure 20:
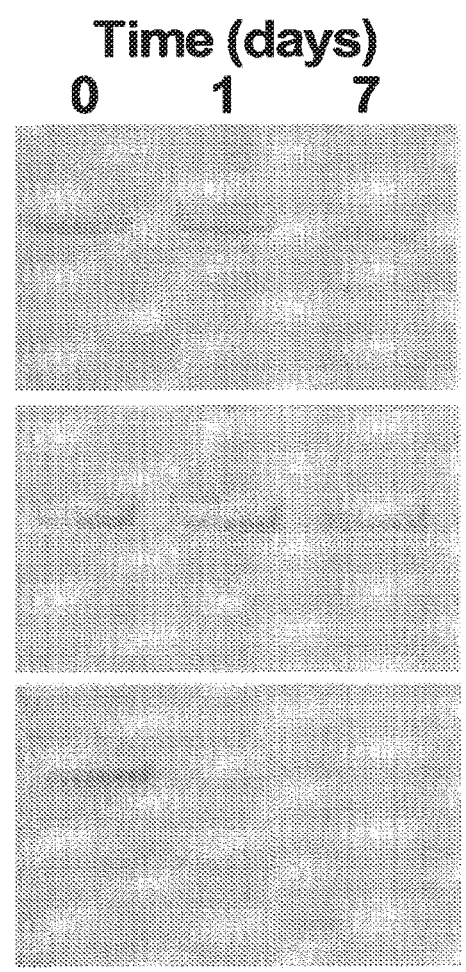
FIGS. 20A-20C show an SDS-PAGE gel of samples from a stability study of the fusion protein of XTEN_AE864 fused to the N-terminus of GFP (see Example 42). The GFP-XTEN was incubated in (A) cynomolgus plasma and (C) rat kidney lysate for up to 7 days at 37° C. In addition, GFP-XTEN administered to (B) cynomolgus monkeys was also assessed. Samples were withdrawn at 0, 1 and 7 days and analyzed by SDS PAGE followed by detection using Western analysis with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 20. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of CFXTEN to degradation due to serum proteases; a factor in the enhancement of pharmacokinetic properties of the CFXTEN fusion proteins.

Example 43: Increasing Solubility and Stability of a Peptide Payload by Linking to XTEN In order to evaluate the ability of XTEN to enhance the physicochemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 36. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 CFXTEN was evaluated for stability, and was found to be stable in liquid formulation for at least 6 months under refrigerated conditions and for approximately one month at 37° C. (data not shown).

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 36

Solubility of Glucagon-XTEN constructs

| Test Article | Solubility |
| --- | --- |
| Glucagon | 60 µM |
| Glucagon-Y36 | >370 µM |
| Glucagon-Y72 | >293 µM |
| Glucagon-AF108 | >145 µM |
| Glucagon-AF120 | >160 µM |
| Glucagon-Y144 | >497 µM |
| Glucagon-AE144 | >467 µM |
| Glucagon-AF144 | >3600 µM |
| Glucagon-Y288 | >163 µM |

Example 44: Analysis of Sequences for Secondary Structure by Prediction Algorithms Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is an XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 37.

The results indicate that, by the Chou-Fasman calculations, short XTEN of the AE and AG families, up to at least 288 amino acid residues, have no alpha-helices or beta-sheets, but amounts of predicted percentage of random coil by the GOR algorithm vary from 78-99%. With increasing XTEN lengths of 504 residues to greater than 1300, the XTEN analyzed by the Chou-Fasman algorithm had predicted percentages of alpha-helices or beta-sheets of 0 to about 2%, while the calculated percentages of random coil increased to from 94-99%. Those XTEN with alpha-helices or beta-sheets were those sequences with one or more instances of three contiguous serine residues, which resulted in predicted beta-sheet formation. However, even these sequences still had approximately 99% random coil formation.

The data provided herein suggests that 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. Results further indicate that XTEN sequences defined herein (including e.g., XTEN created from sequence motifs of G, S, T, E, P, and A) have limited repetitiveness (including those with no more than two identical contiguous amino acids in any one motif) are expected to have very limited secondary structure. Any order or combination of sequence motifs from Table 3 can be used to create an XTEN polypeptide that will result in an XTEN sequence that is substantially devoid of secondary structure, though three contiguous serines are not preferred. The unfavorable property of three contiguous series however, can be ameliorated by increasing the length of the XTEN. Such sequences are expected to have the characteristics described in the CFX-TEN embodiments of the invention disclosed herein.

TABLE 37

CHOU-FASMAN and GOR prediction calculations of polypeptide sequences

| SEQ NAME | SEQ ID NO: | No. Residues | Chou-Fasman Calculation | GOR Calculation |
|---|---|---|---|---|
| AE36: LCW0402_002 | 1489 | 36 | Residue totals: H: 0 E: 0 percent: H: 0.0 E: 0.0 | 94.44% |
| AE36: LCW0402_003 | 1490 | 36 | Residue totals: H: 0 E: 0 percent: H: 0.0 E: 0.0 | 94.44% |
| AG36: LCW0404_001 | 1491 | 36 | Residue totals: H: 0 E: 0 percent: H: 0.0 E: 0.0 | 77.78% |
| AG36: LCW0404_003 | 1492 | 36 | Residue totals: H: 0 E: 0 percent: H: 0.0 E: 0.0 | 83.33 % |
| AE42_1 | 1493 | 42 | Residue totals: H: 0 E: 0 percent: H: 0.0 E: 0.0 | 90.48% |
| AE42_1 | 1494 | 42 | Residue totals: H: 0 E: 0 percent: H: 0.0 E: 0.0 | 90.48% |
| AG42_1 | 1495 | 42 | Residue totals: H: 0 E: 0 percent: H: 0.0 E: 0.0 | 88.10% |
| AG42_2 | 1496 | 42 | Residue totals: H: 0 E: 0 percent: H: 0.0 E: 0.0 | 88.10% |
| AE144 | 1497 | 144 | Residue totals: H: 0 E: 0 percent: H: 0.0 E: 0.0 | 98.61% |
| AG144_1 | 1498 | 144 | Residue totals: H: 0 E: 0 percent: H: 0.0 E: 0.0 | 91.67% |
| AE288 | 1499 | 288 | Residue totals: H: 0 E: 0 percent: H: 0.0 E: 0.0 | 99.31% |
| AG288_2 | 1500 | 288 | Residue totals: H: 0 E: 0 percent: H: 0.0 E: 0.0 | 92.71 |
| AF504 | 1501 | 504 | Residue totals: H: 0 E: 0 percent: H: 0.0 E: 0.0 | 94.44% |
| AD 576 | 1502 | 576 | Residue totals: H: 7 E: 0 percent: H: 1.2 E: 0.0 | 99.65% |
| AE576 | 1503 | 576 | Residue totals: H: 2 E: 0 percent: H: 0.4 E: 0.0 | 99.65% |
| AG576 | 1504 | 576 | Residue totals: H: 0 E: 3 percent: H: 0.4 E: 0.5 | 99.31% |
| AF540 | 1505 | 540 | Residue totals: H: 2 E: 0 percent: H: 0.4 E: 0.0 | 99.65 |
| AD836 | 1506 | 836 | Residue totals: H: 0 E: 0 percent: H: 0.0 E: 0.0 | 98.44% |
| AE864 | 1507 | 864 | Residue totals: H: 2 E: 3 percent: H: 0.2 E: 0.4 | 99.77% |
| AF864 | 1508 | 875 | Residue totals: H: 2 E: 0 percent: H: 0.2 E: 0.0 | 95.20% |
| AG864 | 1509 | 864 | Residue totals: H: 0 E: 0 percent: H: 0.0 E: 0.0 | 94.91% |
| AM875 | 1510 | 875 | Residue totals: H: 7 E: 3 percent: H: 0.8 E: 0.3 | 98.63% |
| AM1318 | 1511 | 1318 | Residue totals: H: 7 E: 0 percent: H: 0.7 E: 0.0 | 99.17% |
| AM923 | 1512 | 924 | Residue totals: H: 4 E: 3 percent: H: 0.4 E: 0.3 | 98.70% |
| AE912 | 1513 | 913 | Residue totals: H: 8 E: 3 percent: H: 0.9 E: 0.3 | 99.45% |
| BC 864 | 1514 | | Residue totals: H: 0 E: 0 percent: H: 0 E: 0 | 99.77% |

H: alpha-helix
E: beta-sheet

Example 45: Analysis of Polypeptide Sequences for Repetitiveness

In this Example, different polypeptides, including several XTEN sequences, were assessed for repetitiveness in the amino acid sequence. Polypeptide amino acid sequences can be assessed for repetitiveness by quantifying the number of times a shorter subsequence appears within the overall polypeptide. For example, a polypeptide of 200 amino acid residues length has a total of 165 overlapping 36-amino acid "blocks" (or "36-mers") and 198 3-mer "subsequences", but the number of unique 3-mer subsequences will depend on the amount of repetitiveness within the sequence. For the analyses, different polypeptide sequences were assessed for repetitiveness by determining the subsequence score obtained by application of the following equation:

$$\text{Subsequence score} = \frac{\sum_{i=1}^{m} \text{Count}_i}{m} \quad \text{I}$$

wherein: m=(amino acid length of polypeptide)-(amino acid length of subsequence)+1; and Count$_i$=cumulative number of occurrences of each unique subsequence within sequence$_i$ In the analyses of the present Example, the subsequence score for the polypeptides of Table 38 were determined using the foregoing equation in a computer program using the algorithm depicted in FIG. 27, wherein the subsequence length was set at 3 amino acids. The resulting subsequence score is a reflection of the degree of repetitiveness within the polypeptide.

The results, shown in Table 38, indicate that the unstructured polypeptides consisting of 2 or 3 amino acid types have high subsequence scores, while those of consisting of the 12 amino acid motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 1694),", resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5), while XTEN consisting of four motifs containing five types of amino acids were intermediate; i.e., AE864, with a score of 7.2.

Conclusions:

The results indicate that the combination of 12 amino acid subsequence motifs, each consisting of four to six amino acid types that are non-repetitive, into a longer XTEN polypeptide results in an overall sequence that is substantially non-repetitive, as indicated by overall subsequence scores less than 10 and, in many cases, less than 5. This is despite the fact that each subsequence motif may be used multiple times across the sequence. In contrast, polymers created from smaller numbers of amino acid types resulted in higher subsequence scores, with polypeptides consisting of two amino acid type having higher scores that those consisting of three amino acid types.

TABLE 38

Subsequence score calculations of polypeptide sequences

| Seq Name | SEQ ID NO: | Score |
|---|---|---|
| J288 | 1515 | 33.3 |
| K288 | 1516 | 46.9 |
| L288 | 1517 | 50.0 |
| Y288 | 1518 | 26.8 |
| Q576 | 1519 | 18.5 |
| U576 | 1520 | 18.1 |
| W576 | 1521 | 23.4 |
| Y576 | 1522 | 15.7 |
| AE288 | 1523 | 6.0 |
| AG288_1 | 1524 | 6.9 |
| AD576 | 1525 | 13.6 |
| AE576 | 1526 | 6.1 |
| AF540 | 1527 | 8.8 |
| AF504 | 1528 | 7.0 |
| AE864 | 1529 | 6.1 |
| AF864 | 1530 | 7.5 |
| AG864 | 1531 | 7.2 |
| AG868 | 1532 | 7.5 |
| AM875 | 1533 | 4.5 |
| AE912 | 1534 | 4.5 |
| AM923 | 1535 | 4.5 |
| AM1296 | 1536 | 4.5 |

Example 46: Calculation of TEPITOPE Scores

TEPITOPE scores of 9mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 39 shows as an example the pocket potentials for HLA0101B, which occurs in high frequency in the Caucasian population. To calculate the TEPITOPE score of a peptide with sequence P1-P2-P3-P4-P5-P6-P7-P8-P9, the corresponding individual pocket potentials in Table 39 were added. The HLA0101B score of a 9mer peptide with the sequence FDKLPRTSG (SEQ ID NO: 1695) is the sum of 0, −1.3, 0, 0.9, 0, −1.8, 0.09, 0, 0.

To evaluate the TEPITOPE scores for long peptides one can repeat the process for all 9mer subsequences of the sequences. This process can be repeated for the proteins encoded by other HLA alleles. Tables 40-43 give pocket potentials for the protein products of HLA alleles that occur with high frequency in the Caucasian population.

TEPITOPE scores calculated by this method range from approximately −10 to +10. However, 9mer peptides that lack a hydrophobic amino acid (FKLMVWY (SEQ ID NO: 1696)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9mer subsequences will have TEPITOPEs in the range in the range of −1009 to −989. This method confirms that XTEN polypeptides may have few or no predicted T-cell epitopes.

TABLE 39

Pocket potential for HLA0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |
| F | 0 | 0 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |
| N | −999 | 0.8 | 0.5 | 0.04 | — | −1.1 | 0.1 | — | −1.2 |
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.1 | — | −1.4 |
| Y | 0 | 0.9 | 0.8 | −1.1 | — | −2 | 0.5 | — | −0.9 |

TABLE 40

Pocket potential for HLA0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | −0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 41

Pocket potential for HLA0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 1.4 | — | −1.1 | −0.3 | — | −1.7 |
| E | −999 | 0.1 | −1.2 | 1.5 | — | −2.4 | 0.2 | — | −1.7 |
| F | 0 | 0.8 | 0.8 | −0.9 | — | −1.1 | −1 | — | −1 |
| G | −999 | 0.5 | 0.2 | −1.6 | — | −1.5 | −1.3 | — | −1 |
| H | −999 | 0.8 | 0.2 | 1.1 | — | −1.4 | 0 | — | 0.08 |
| I | −1 | 1.1 | 1.5 | 0.8 | — | −0.1 | 0.08 | — | −0.3 |
| K | −999 | 1.1 | 0 | −1.7 | — | −2.4 | −0.3 | — | −0.3 |
| L | −1 | 1 | 1 | 0.8 | — | −1.1 | 0.7 | — | −1 |
| M | −1 | 1.1 | 1.4 | 0.9 | — | −1.1 | 0.8 | — | −0.4 |
| N | −999 | 0.8 | 0.5 | 0.9 | — | 1.3 | 0.6 | — | −1.4 |
| P | −999 | −0.5 | 0.3 | −1.6 | — | 0 | −0.7 | — | −1.3 |
| Q | −999 | 1.2 | 0 | 0.8 | — | −1.5 | 0 | — | 0.5 |

TABLE 41-continued

Pocket potential for HLA0301B allele.

| Amino acid | P1 | P2 | P3 | P4 | P5 | P6 | P7 | P8 | P9 |
|---|---|---|---|---|---|---|---|---|---|
| R | −999 | 2.2 | 0.7 | −1.9 | — | −2.4 | −1.2 | — | −1 |
| S | −999 | −0.3 | 0.2 | 0.8 | — | 1 | −0.2 | — | 0.7 |
| T | −999 | 0 | 0 | 0.7 | — | 1.9 | −0.1 | — | −1.2 |
| V | −1 | 2.1 | 0.5 | −0.9 | — | 0.9 | 0.08 | — | −0.7 |
| W | 0 | −0.1 | 0 | −1.2 | — | −1 | −1.4 | — | −1 |
| Y | 0 | 0.9 | 0.8 | −1.6 | — | −1.5 | −1.2 | — | −1 |

TABLE 42

Pocket potential for HLA0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −1.6 | — | −2.5 | −1.3 | — | −1.2 |
| E | −999 | 0.1 | −1.2 | −1.4 | — | −2.5 | 0.9 | — | −0.3 |
| F | 0 | 0.8 | 0.8 | 0.2 | — | −0.8 | 2.1 | — | 2.1 |
| G | −999 | 0.5 | 0.2 | −1.1 | — | −0.6 | 0 | — | −0.6 |
| H | −999 | 0.8 | 0.2 | 0.1 | — | −0.8 | 0.9 | — | −0.2 |
| I | −1 | 1.1 | 1.5 | 1.1 | — | −0.5 | 2.4 | — | 3.4 |
| K | −999 | 1.1 | 0 | −1.3 | — | −1.1 | 0.5 | — | −1.1 |
| L | −1 | 1 | 1 | −0.8 | — | −0.9 | 2.2 | — | 3.4 |
| M | −1 | 1.1 | 1.4 | −0.4 | — | −0.8 | 1.8 | — | 2 |
| N | −999 | 0.8 | 0.5 | −1.1 | — | −0.6 | 1.4 | — | −0.5 |
| P | −999 | −0.5 | 0.3 | −1.2 | — | −0.5 | −0.2 | — | −0.6 |
| Q | −999 | 1.2 | 0 | −1.5 | — | −1.1 | 1.1 | — | −0.9 |
| R | −999 | 2.2 | 0.7 | −1.1 | — | −1.1 | 0.7 | — | −0.8 |
| S | −999 | −0.3 | 0.2 | 1.5 | — | 0.6 | 0.4 | — | −0.3 |
| T | −999 | 0 | 0 | 1.4 | — | −0.1 | 0.9 | — | 0.4 |
| V | −1 | 2.1 | 0.5 | 0.9 | — | 0.1 | 1.6 | — | 2 |
| W | 0 | −0.1 | 0 | −1.1 | — | −0.9 | 1.4 | — | 0.8 |
| Y | 0 | 0.9 | 0.8 | −0.9 | — | −1 | 1.7 | — | 1.1 |

TABLE 43

Pocket potential for HLA0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −0.4 | — | −0.4 | −0.7 | — | −1.9 |
| E | −999 | 0.1 | −1.2 | −0.6 | — | −1 | −0.7 | — | −1.9 |
| F | −1 | 0.8 | 0.8 | 2.4 | — | −0.3 | 1.4 | — | −0.4 |
| G | −999 | 0.5 | 0.2 | 0 | — | −0.5 | 0 | — | −0.8 |
| H | −999 | 0.8 | 0.2 | 1.1 | — | −0.5 | 0.6 | — | −1.1 |
| I | 0 | 1.1 | 1.5 | 0.6 | — | −0.05 | 1.5 | — | 0.7 |
| K | −999 | 1.1 | 0 | −0.7 | — | −0.3 | −0.3 | — | −1.7 |
| L | 0 | 1 | 1 | 0.5 | — | −0.2 | 1.9 | — | 0.5 |
| M | 0 | 1.1 | 1.4 | 1 | — | −0.1 | 1.7 | — | 0.08 |
| N | −999 | 0.8 | 0.5 | −0.2 | — | −0.7 | 0.7 | — | −1.2 |
| P | −999 | −0.5 | 0.3 | −0.3 | — | −0.2 | 0.3 | — | −1.1 |
| Q | −999 | 1.2 | 0 | −0.8 | — | −0.8 | −0.3 | — | −1.6 |
| R | −999 | 2.2 | 0.7 | 0.2 | — | 1 | −0.5 | — | −1 |
| S | −999 | −0.3 | 0.2 | −0.3 | — | −0.6 | 0.3 | — | −0.3 |
| T | −999 | 0 | 0 | −0.3 | — | −0 | 0.2 | — | −0.2 |
| V | 0 | 2.1 | 0.5 | 0.2 | — | −0.3 | 0.3 | — | 0.3 |
| W | −1 | −0.1 | 0 | 0.4 | — | −0.4 | 0.6 | — | −1.4 |
| Y | −1 | 0.9 | 0.8 | 2.5 | — | −0.4 | 0.7 | — | −0.9 |

Example 46: Assessment of Insertion of XTEN into Permissive Loops

XTEN AE42-4 Insertion

The construction and expression of FVIII with XTEN AE42 insertions were described in Example 17 and 24. Thus, where residue X designates the site of insertion and residue Z designates the next residue in the native FVIII polypeptide sequence, the polypeptide resulting from insertion of XTEN AE42 would contain the sequence:

```
                                          (SEQ ID NO: 1697)
X-GAPGSPAGSPTSTEEGTSESATPESGPGSEPATSGSETPASS-Z
```

Figure 32:
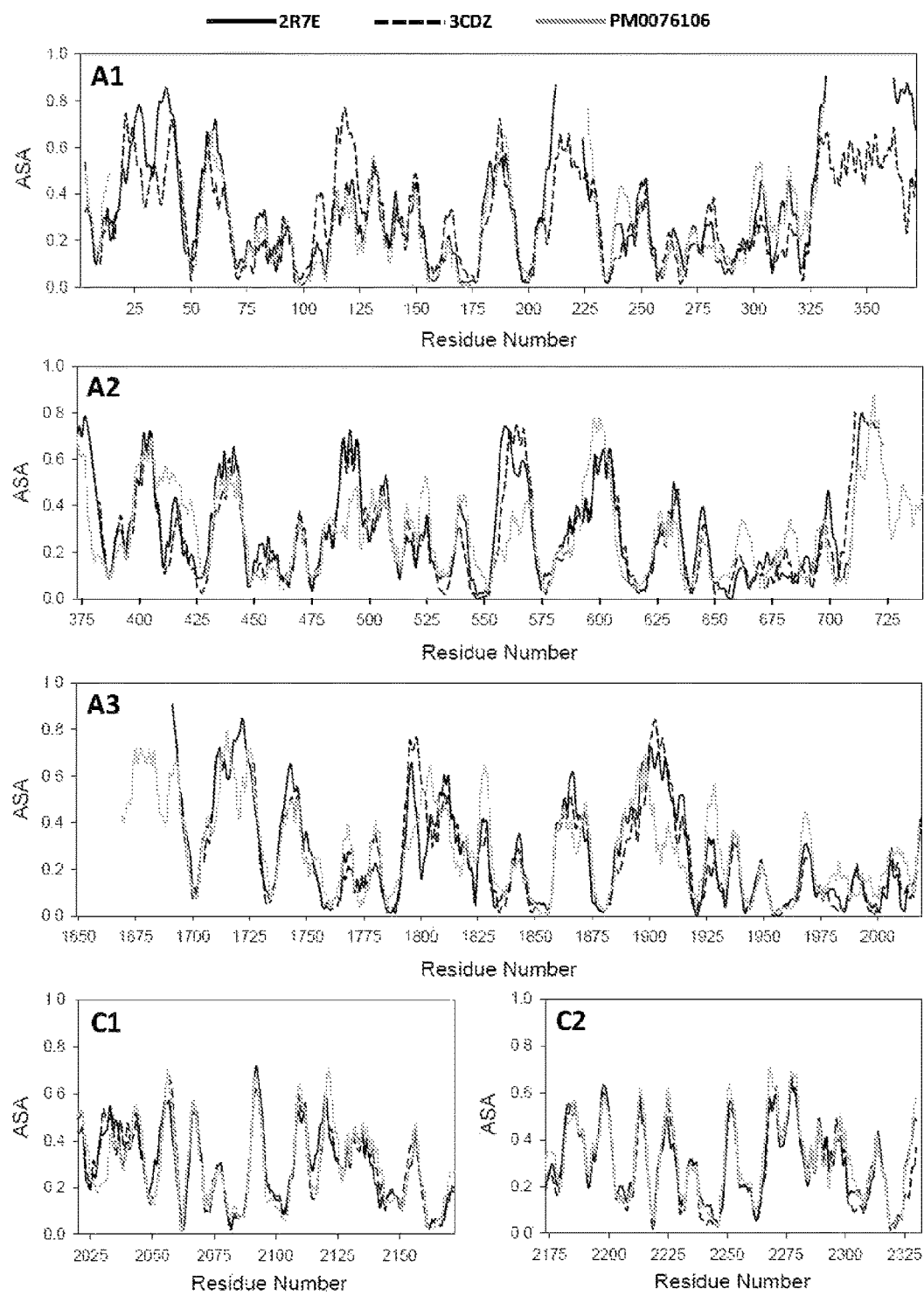
FIG. 32 shows the graphical ASAView outputs for structural datasets 2R7E, 3CDZ, and PM0076106. Accessible Solvent Areas (ASA) for the amino acids in domains A1, A2, A3, C1 and C2 are shown. Analyses were performed on X-ray crystallographic coordinates 3CDZ (Ngo et al., Structure 16: 597-606 (2008)) and 2R7E (Shen et al., Blood 111:1240-1247 (2008)) deposited in the Protein Data Bank maintained by the Research Collaboratory for Structural Bioinformatics (RCSB; http://www.rcsb.org/pdb), as well as on atomic coordinates PM0076106 for the predicted refined FVIII structure derived from a molecular dynamics simulation study (Venkateswarlu, BMC Struct. Biol. 10:7 (2010)) deposited in the Protein Model Database (http://ml.caspur.it/PMDB/main.php) maintained by Consorzio Interuniversitario per le Applicazioni di Supercalcolo per Università e Riserca (CASPUR) and the Department of Biochemical Sciences of the University of Rome.

16 different sites in the FVIII sequence were selected for XTEN AE42 insertion, and these were designed Batch 1. An additional 21 sites selected for XTEN AE42 insertion were designed Batch 2. Collectively, the Batch 1 and Batch 2 sites represent 12 sites in the A1 domain, 7 sites in the A2 domain, 10 sites in the A3 domain, 4 sites in the C1 domain, and 3 sites in the C2 domain. Locations of Batch 1 and 2 sites in the 3-D structure of FVIII are depicted in FIG. 32.

The location of these Batch 1 and Batch 2 insertion sites results in 37 constructs designated pSD0001-pSD0004, pSD0009-pSD0012, pSD0023-pSD0032, pSD0034-pSD0063 [the foregoing ranges include all intermediate numbers, as well], the sequences of which are set forth in Table 21 and the insertions sites of which are set forth in Table 23.

In Vitro Assays

To assess FVIII tolerability to XTEN AE42-4 insertion, the FVIII activity in culture media samples from FVIII-XTEN cell cultures was analyzed using a FVIII chromogenic assay. Antigen expression levels were analyzed by FVIII-HC (FVIII heavy chain) and FVIII-LC (FVIII light chain) ELISA.

FVIII Activity Measurement by Chromogenic Assay

The FVIII activity was measured using the COATEST® SP FVIII kit from DiaPharma (lot# N089019) and all incubations were performed on a 37° C. plate heater with shaking. Cell culture harvests from transient transfection media of FVIII-XTEN AE42-4 variants from 6 well plates were diluted to the desired FVIII activity range using 1×FVIII COATEST R buffer. FVIII standards were prepared in 1×FVIII COATEST R buffer containing mock transfection media with matching culture media concentration as the testing sample. The range of recombinant Factor VIII (rFVIII) standard was from 100 mIU/mL to 0.78 mIU/mL. The standards, diluted cell culture samples, and a pooled normal human plasma assay control were added to Immulon® 2HB 96-well plates in duplicates (25 µL/well).

Freshly prepared IXa/FX/Phospholipid mix (50 µL), 25 µL of 25 mM CaCl$_2$, and 50 µL of FXa substrate were added sequentially into each well, with 5 minutes incubation between each addition. After incubating with the substrate, 25 µL of 20% acetic acid was added to terminate the color reaction, and the absorbance at 405 nm was measured with a SpectraMAX R plus (Molecular Devices) instrument.

Data analysis was performed using SoftMax Pro software (version 5.2). The Lowest Level of Quantification (LLOQ) was 39 mIU/mL. Results are presented in Table 22.

Expression Measurement by FVIII-HC and FVIII-LC ELISA

Expression of variants was quantified using ELISA. The FVIII antigen expression levels of DNA constructs corresponding to XTEN insertions in the A1 and A2 domains of FVIII were analyzed by FVIII-LC ELISA. The FVIII antigen expression levels of DNA constructs corresponding to XTEN insertions in the A3, C1 and C2 domains of FVIII were analyzed by FVIII-HC ELISA. Results are presented in Table 22.

FVIII-XTEN antigens in cell culture media after harvest were captured by GMA011 antibodies (Green Mountain Antibodies) for FVIII-LC ELISA) or by GMA016 antibodies (Green Mountain Antibodies) for FVIII-HC ELISA. Immulon® 2HB 96-well plates were coated with 100 μl/well of anti-FVIII antibody (2 μg/ml) by overnight incubation at 4° C. Plates were then washed four times with Phosphate Buffer saline with Tween-20 (PBST) and blocked with blocking buffer (PBST with 10% heat inactivated horse serum) for 1 hour at room temperature.

Cell culture harvests from transient transfection media of FVIII-XTEN variants from a 6-well plate were diluted to the desired FVIII antigen range using 1× blocking buffer. FVIII standards were prepared in 1×FVIII blocking buffer containing mock transfection media with matching media concentration as the testing samples. The range of rFVIII standard was from 50 ng/mL to 0.39 ng/mL.

Standards, diluted cell culture samples, and a pooled normal human plasma assay control were added into Immulon® 2HB 96-well plates in duplicates (100 μL/well) and incubated at 37° C. for 2 hours. Following four times washing with PBST, 100 μl of HRP-sheep anti-hFVIII antibody (Affinity Biologicals, F8C-EIC-D) were added into each well and plates were incubated for 1 hour at 37° C. After another four washes with PBST, 100 μl of TMB Super Sensitive Substrate (BioFX) were added to each well, followed by 5-10 min color development. To terminate the color reaction, 50 μL of H2SO4 were added to each well, and the absorbance of at 450 nm was measured with a Spectra-MAX plus (Molecular Devices) instrument.

Data analysis was performed using SoftMax Pro software (version 5.4). The Lowest Level of Quantification (LLOQ) was 0.0039 μg/mL. Results are presented in Table 22.

Figure 33:
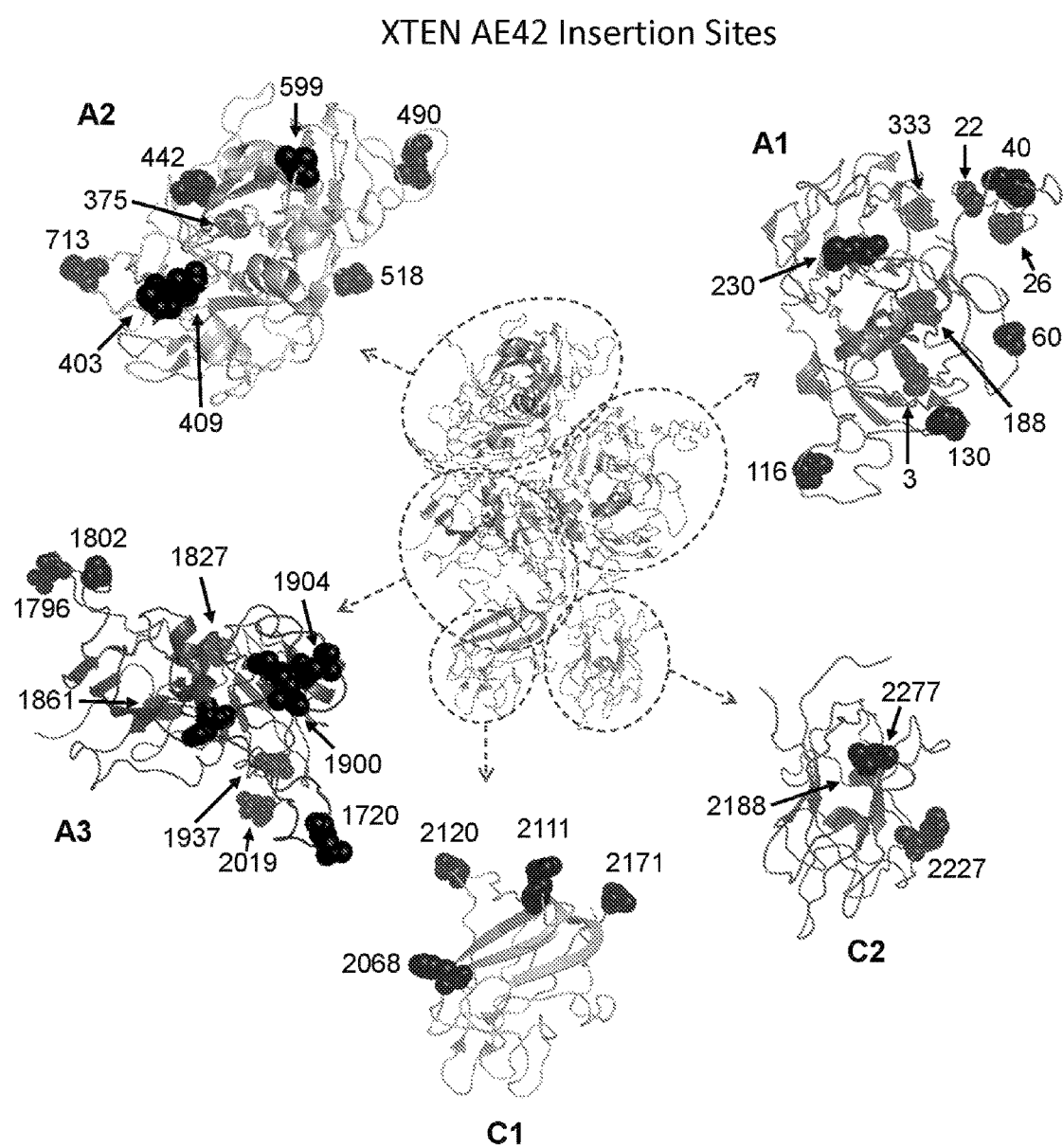
FIG. 33 shows a structural representation of the location of XTEN insertion sites. The central drawing corresponding to the crystal structure of FVIII (PDB: 2R7E) is surrounded by detailed view of domains A1, A2, A3, C1 and C2. Beta strands and alpha helices are shown as ribbon representation. Loops are shown as alpha carbon pipes. The amino acids at XTEN insertion sites are shown as CPK sphere representation. The number in each graph indicate the location of the XTEN insertion sites according to the numbering in FIG. 30.
Figure 36:
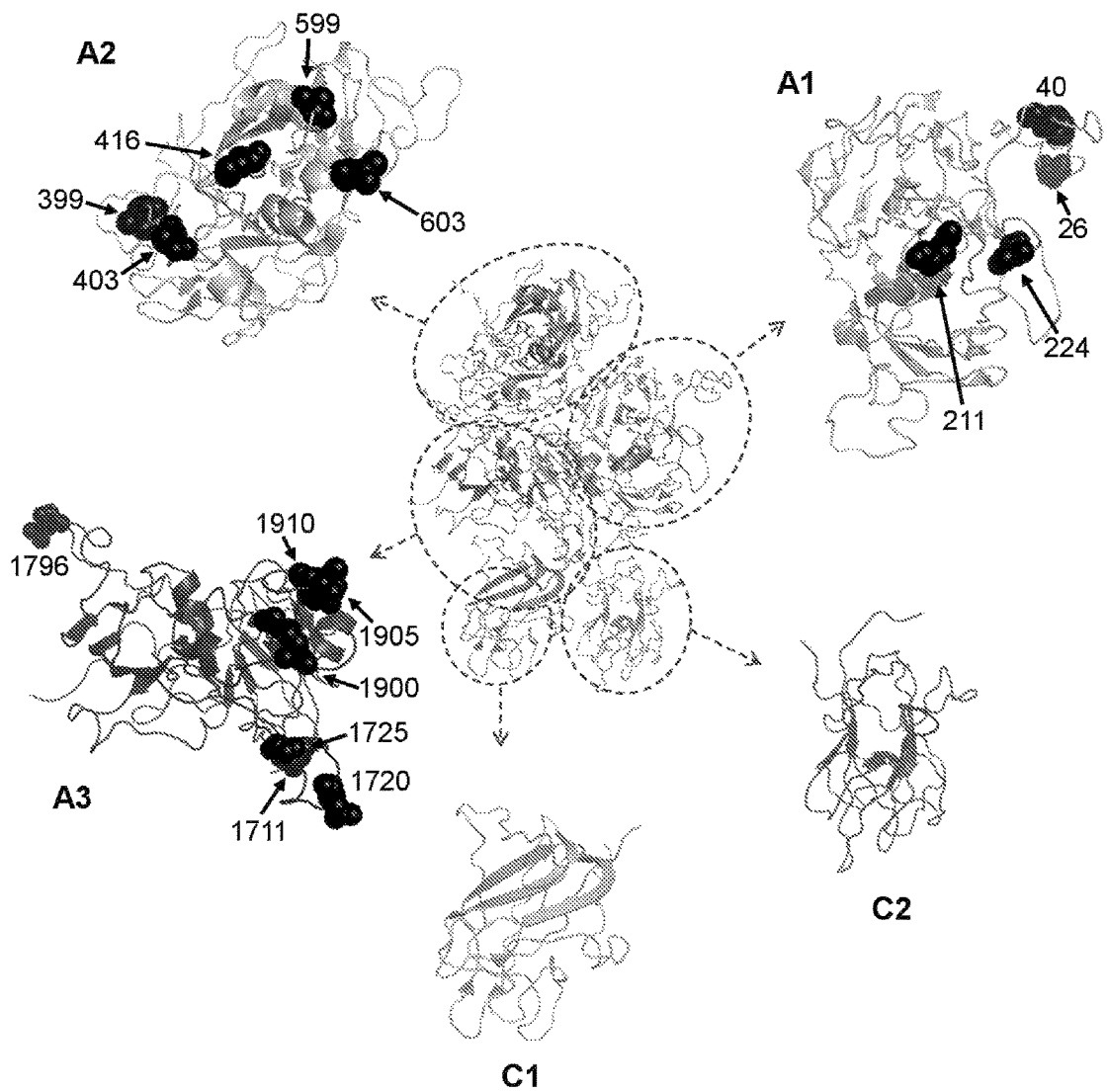
FIG. 36 shows a structural representation of the location of XTEN insertion sites shown in FIG. 35 wherein the resulting recombinant FVIII protein displays FVIII activity.

Permissive sites into which XTEN sequences were inserted without eliminating procoagulant activity of the recombinant protein, or the ability of the recombinant proteins to be expressed in the host cell were clustered within loops in each of the three A domains of FVIII. FIG. 36 shows the location of insertion sites in the recombinant FVIII proteins that showed FVIII activity on domains A1, A2 and A3. FIG. 33 shows a structural representation depicting the location of insertion sites in the recombinant FVIII proteins that showed FVIII activity.

The permissive sites clustered in solvent exposed, highly flexible surface loops (XTEN permissive loops). The A1 domain loops were located in a region corresponding approximately to amino acid positions 15 to 45, and 201 to 232, respectively, in the sequence of mature human FVIII (FIG. 30). The A2 domain loops were located in a region corresponding approximately to amino acid positions 395 to 421, and 577 to 635, respectively, in the sequence of mature human FVIII (FIG. 30). The A3 domain loops were located in a region corresponding approximately to amino acid positions 1705 to 1732, and 1884 to 1917, respectively, in the sequence of mature human FVIII (FIG. 30). FIGS. 37A and 37B show the location of the XTEN permissive loops relative to secondary structure elements in the tridimensional structure of FVIII.

Example 47: CFXTEN with Insertions of XTEN Having 144 Amino Acids

Analysis of the preliminary data presented above (Example 46) suggested the existence of defined regions within the linear polypeptide sequences and 3-D structures of the FVIII A domains that can accommodate the insertion of XTEN sequences. To test this hypothesis and further define the boundaries of putative regions that can accommodate the insertion of XTEN sequences without loss of FVIII activity, 23 additional insertion sites not present in either Batch 1 or 2 were chosen and designated Batch 3.

Batch 3 constructs were generated by the insertion of a 144 residue XTEN AE polypeptide, comprising amino acid residues Gly (G), Ala (A), Pro (P), Ser (S), Thr (T), and Glu (E), or a 144 residue XTEN AG polypeptide, comprising amino acid residues Gly (G), Ala (A), Pro (P), Ser (S), and Thr (T). Five different version of the 144 residue AE polypeptide were generated and designated XTEN-AE144-2A, XTEN-AE144-3B, XTEN-AE144-4A, XTEN-AE144-5A, XTEN-AE144-6B. The amino acid sequences are as set forth in Table 4. Five different versions of the 144 residue polypeptide were generated and designated XTEN-AG144-1, XTEN-AG144-A, XTEN-AG144-B, XTEN-AG144-C, and XTEN-AG144-F. The amino acid sequences are as set forth in Table 4.

The 144 residue XTEN encoding DNA sequence was introduced by the chemical synthesis of DNA segments (DNA 2.0, Redwood City, Calif.) spanning the nearest unique restriction sites within the base vector on either side of the site of insertion.

The DNA sequences corresponding to the XTEN 144 peptides were inserted such that the resulting DNA construct would encode a FVIII protein in which the XTEN 144 protein sequence is inserted immediately after the residue indicated in the site selection, and flanked by AscI and XhoI sites.

Figure 34:
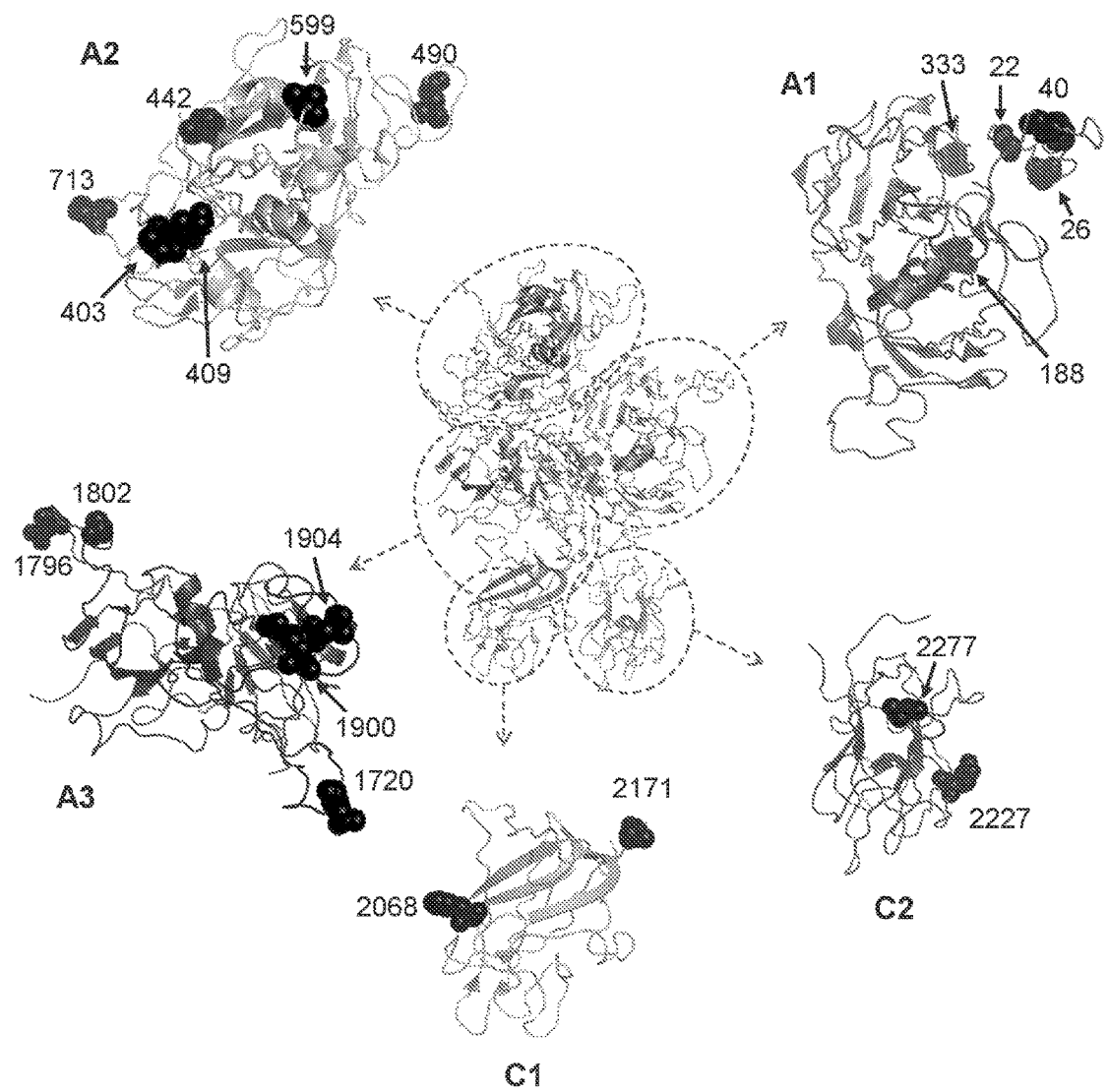
FIG. 34 shows a structural representation of the location of XTEN insertion sites shown in FIG. 33 wherein the resulting recombinant FVIII protein displays FVIII activity.

In addition to these sites, those sites from Batch 1 and 2 at which insertion of the XTEN AE42 polypeptide did not abolish FVIII procoagulant activity were modified by excision of the AE42 polypeptide encoding DNA segment with restriction enzymes AscI and XhoI, and introduction of XTEN AE144 and XTEN AG144 coding sequences at the same sites. The location of these Batch 1, Batch 2 and Batch insertion sites is summarized in Table III. FIG. 34 presents a structural representation of FVIII showing the location of the XTEN 144 insertion sites.

A total of 48 constructs with 144 XTEN inserts were created. The constructs are pSD0001-pSD0004, pSD0009-pSD0012, pSD0023-63 [the foregoing ranges include all intermediate numbers, as well], the sequences of which are set forth in Table 21 and the insertion sites of which are detailed in Table 22.

Expression of FVIII-XTEN 144 Variants

FVIII variants with XTEN 144 insertions were transfected into HEK293F cells (Invitrogen, Carlsbad, Calif.) using polyethyleneimine (PEI, Polysciences Inc. Warrington, Pa.) or Lipofectamine transfection reagent (Invitrogen, Carlsbad, Calif.). The transiently transfected cells were grown in 293 Free Style medium or a mixture of 293 Free Style and CD Opti CHO media (Invitrogen, Carlsbad, Calif.). The cell culture medium was harvested 3-5 days after transfection and analyzed for FVIII expression by chromogenic FVIII activity assay and FVIII ELISA conducted as described herein.

Cell culture media from transient transfection were concentrated 10-fold in Centricon® spin columns (100 kd cut-off). Concentrated material was then flash frozen and stored at −80° C. for future in vitro analysis and in vivo PK studies.

In Vitro Assays

To assess FVIII tolerability to insertions, the FVIII activity in culture media samples from cell cultures was analyzed using a FVIII chromogenic assay. Antigen expression levels were analyzed by FVIII-HC (FVIII heavy chain) and FVIII-LC (FVIII light chain) ELISA.

FVIII Activity Measurement by Chromogenic Assay and Expression Measurement by FVIII-HC and FVIII-LC ELISA Chromogenic and ELISA assay methods were conducted as described. The results obtained are summarized in Table 23.

Figure 35:
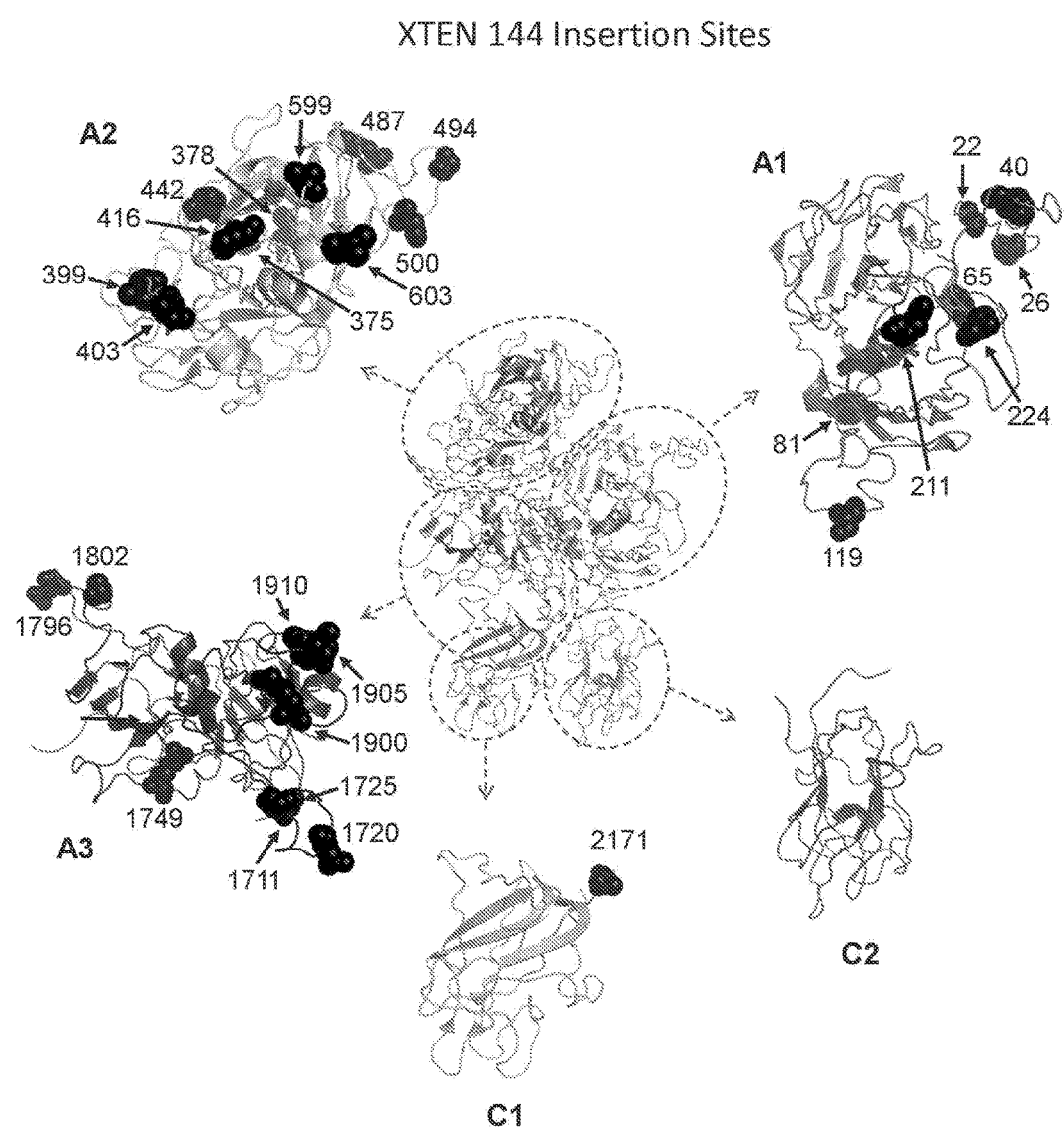
FIG. 35 shows a structural representation of the location of XTEN insertion sites shown in FIG. 34 wherein the resulting recombinant FVIII protein displays FVIII activity.
Figure 38:
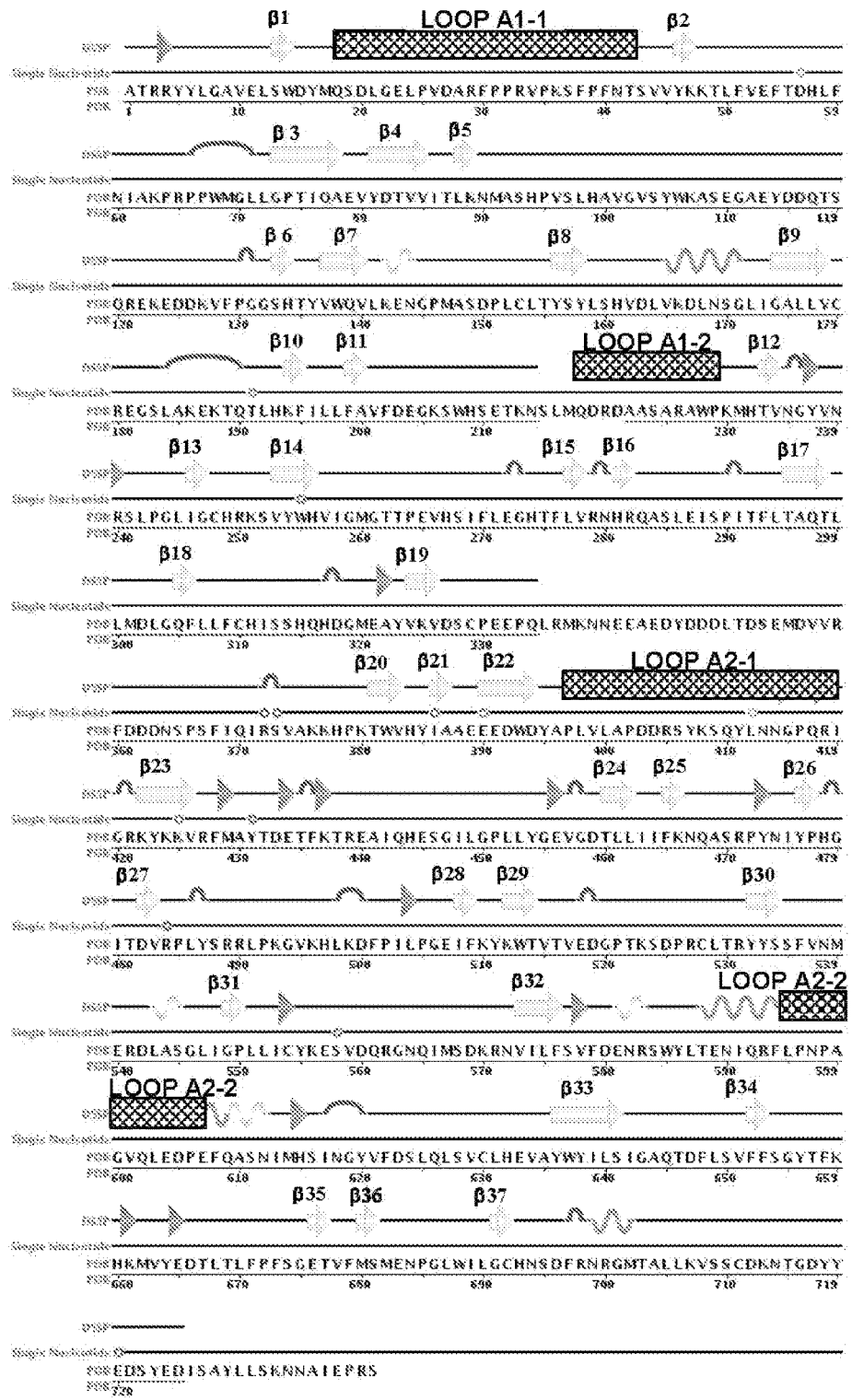
Figure 39:
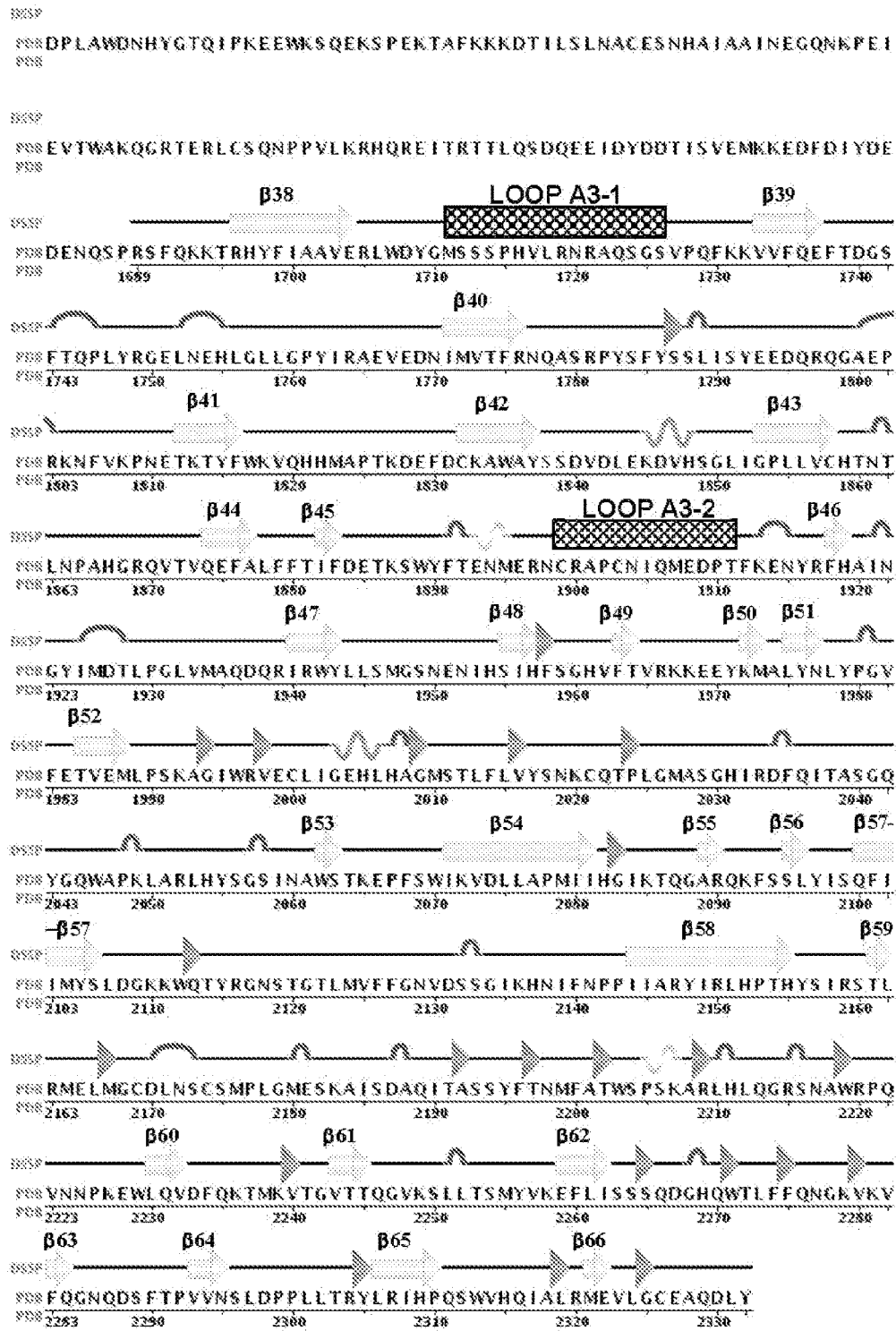

Permissive sites into which XTEN sequences were inserted without eliminating procoagulant activity of the recombinant protein, or the ability of the recombinant proteins to be expressed in the host cell clustered within loops in each of the three A domains of FVIII. The same XTEN permissive loop regions tolerating the shorter XTEN sequences inserted were found to tolerate the insertion of the longer XTEN sequences. FIG. 38 shows the location of XTEN 144 insertion sites in the recombinant FVIII proteins that showed FVIII activity on domains A1, A2 and A3. FIG. 35 shows a structural representation depicting the location of insertion sites in the recombinant FVIII proteins that showed FVIII activity.

Figure 41:
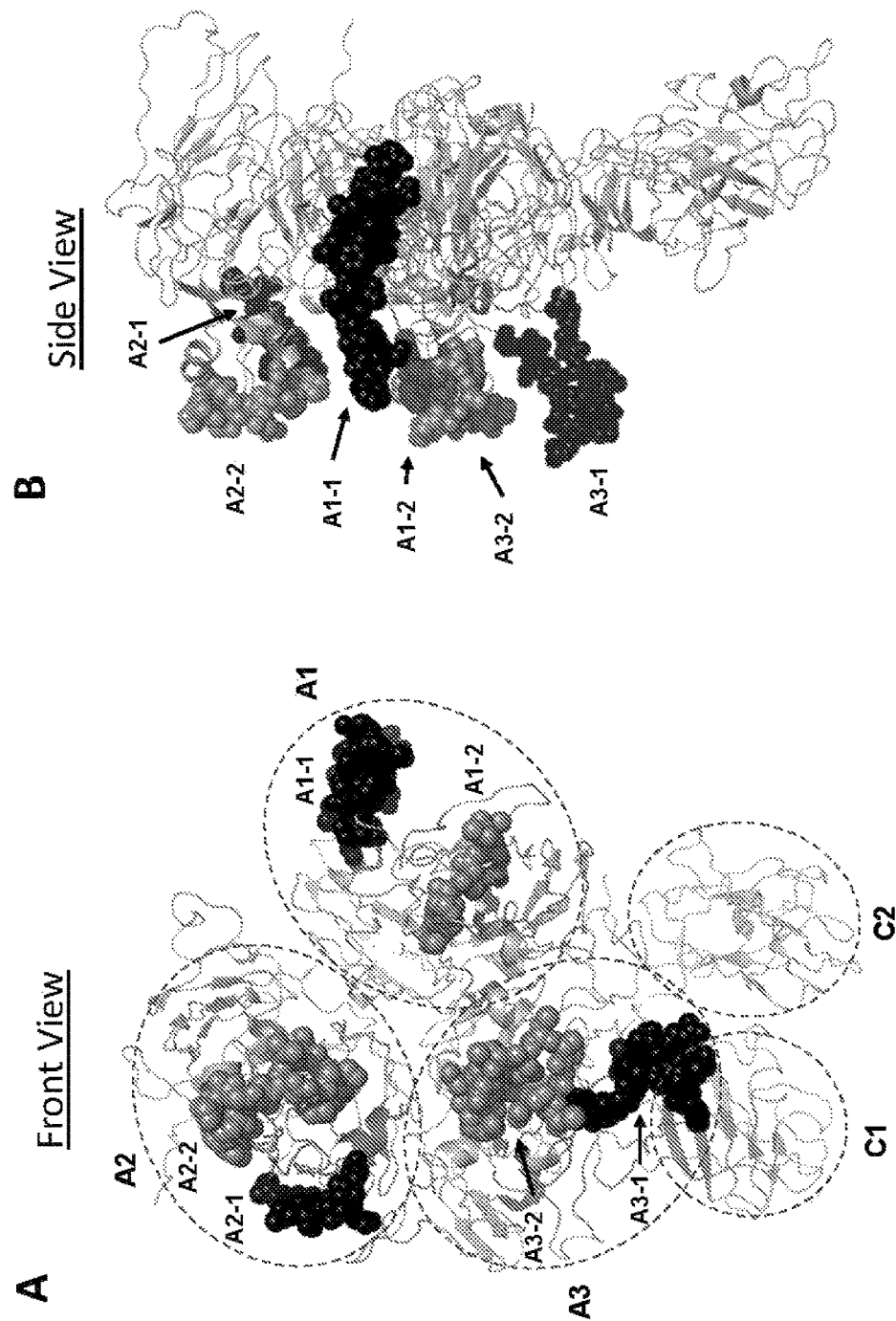
Figure 42:
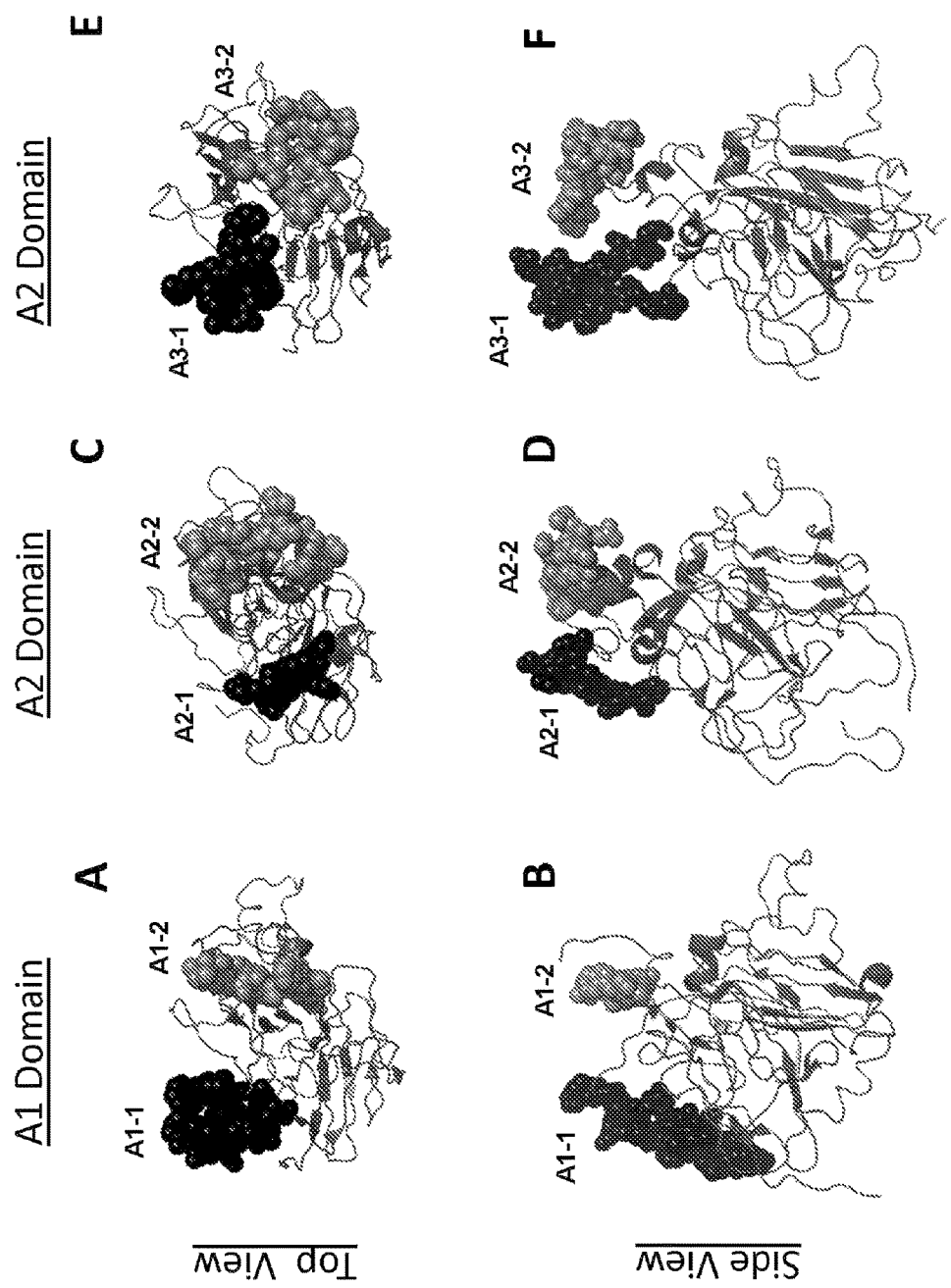

These observation indicate that two regions within each of the A domains of FVIII are able to accommodate insertion of XTEN sequences without loss of FVIII cofactor activity. A structural depiction of these so-called XTEN permissive loops (FIGS. 40 and 41) demonstrate that they occupy structurally analogous positions in each of the A domains and project from one face of the FVIII molecule. The identified XTEN permissive loops correspond to highly flexible loops located between beta strands in the three-dimensional structures of the A1, A2, and A3 domains, as shown in FIGS. 37A and 37B.

The in vivo evaluation of XTEN 144 insertions on FVIII Half-life Extension, as determined by pharmacokinetics, is described in Example 32.

Example 48: Rescue or Enhancement of FVIII Expression by Insertion of an XTEN Sequence within the a3 Acidic Peptide Region of FVIII Adherent HEK293 cells were transfected (as described in Example 24) with FVIII-XTEN DNA constructs in which the coding sequence of a B-domain deleted factor VIII contained 2 to 4 XTEN insertions of 144 amino acid residues each, of composition and insertion location as indicated in Table 44, below. At 5 days post-transfection, cell culture supernatants were assayed for FVIII activity by the chromogenic assay (as described in Example 25). Results are shown in Table 44.

TABLE 44

Expression levels of FVIII Activity by CFXTEN variants containing an XTEN at position 1720 and one, two, or three additional XTEN insertions.

| Construct Name | Domain, Position, and Type of XTEN Insertion | | | | | Activity (mIU/mL) |
| --- | --- | --- | --- | --- | --- | --- |
| | A1 | A2 | a3 | A3-1 | A3-2 | |
| LSD0040.002 | 26 AG144 | | | 1720 AG144 | | 175 |
| LSD0041.008 | | 403 AE144 | | 1720 AG144 | | 279 |
| LSD0045.002 | | | 1656 AG144 | 1720 AG144 | | 2598 |
| PSD080.002 | 26 AG144 | | 1656 AG144 | 1720 AG144 | | 1081 |

TABLE 44-continued

Expression levels of FVIII Activity by CFXTEN variants containing an XTEN at position 1720 and one, two, or three additional XTEN insertions.

| Construct Name | Domain, Position, and Type of XTEN Insertion | | | | | Activity (mIU/mL) |
| --- | --- | --- | --- | --- | --- | --- |
| | A1 | A2 | a3 | A3-1 | A3-2 | |
| PSD083.001 | | 403 AE144 | 1656 AG144 | 1720 AG144 | | 789 |
| PSD082.001 | 26 AG144 | | | 1720 AG144 | 1900 AE144 | <LLOQ |
| PSD090.003 | 26 AG144 | | 1656 AG144 | 1720 AG144 | 1900 AE144 | 316 |

For the purpose of comparison, all FVIII-XTEN constructs had an AG144 XTEN insertion at amino acid position 1720 (numbered relative to full-length factor VIII) within the A3 domain. Expression levels of FVIII-XTEN varians were determined by chromogenic assay and expressed in units of mIU/mL. Constructs with a single additional XTEN insertion at either position 26 in the A1 domain (LSD0040.002) or position 403 in the A2 domain (LSD0041.008) yielded expression levels of 175 and 279 mIU/mL, respectively. In contrast, a construct with a single additional XTEN insertion at position 1656 within the a3 acidic peptide yielded an expression level of 2598 mIU/mL, demonstrating enhancement of expression level for the a3 XTEN insertion construct relative to the A1 and A2 insertion constructs. In addition, in comparison to the FVIII-XTEN construct with XTEN insertions at positions 26 in the A1 domain and 1720 in the A3 domain (LSD0040.002), the construct with an additional XTEN insertion at position 1656 within the a3 acidic peptide region (PSD080.002) yielded significantly higher expression (175 and 1081 mIU/mL, respectively). Consistent with these findings, the construct with XTEN insertions at positions 403 in the A2 domain and 1720 in the A3 domain (LSD0041.008) yielded an expression level of 279 mIU/mL, whereas an additional XTEN insertion at position 1656 within the a3 acidic peptide region (PSD083.001) resulted in an increase in the expression level to 789 mIU/mL. Lastly, the FVIII-XTEN construct with an XTEN insertion at position 26 within the A1 domain and two XTEN insertions at positions 1720 and 1900 within the A3 domain (PSD082.001) did not yield activity above the lower limit of quantitation. However, the FVIII-XTEN construct with an additional XTEN insertion within the a3 acidic peptide region (PSD090.003) resulted in detectable activity, demonstrating that inclusion of an XTEN sequence within the a3 domain can result in recovery of expression (as measured by activity) in FVIII-XTEN constructs that are otherwise expressed at levels below the lower limit of quantitation. Under the conditions of the experiment, the results support the conclusion that insertion of XTEN at the 1656 position and, by extension, within the a3 region, results in enhanced expression of procoagulant FVIII-XTEN compositions.

Example 49: Effect of XTEN Insertion on FVIII Activity Measured by aPTT

A one stage activated partial prothrombin (aPTT) coagulation assay was employed in addition to the chromogenic assay (as described in Example 25) to determine FVIII activity of various FVIII-XTEN fusion proteins.

Method:

The FVIII-XTEN aPTT activity was measured using the Sysmex CA-1500 instrument (Siemens Healthcare Diagnostics Inc., Tarrytown, N.Y.). To create a standard curve for the assay, WHO factor VIII standard was diluted with 2% mock transfection media to 100 mU/mL and a two-fold serial dilution series was then performed, with the last standard being 0.78 mU/mL. FVIII-XTEN cell culture samples were first diluted at 1:50 with aPTT assay buffer, further dilutions were made with 2% mock transfection media when needed.

After dilution, the aPTT assay was performed using Sysmex instrument as follow: 50l of diluted standards and samples were mixed with 50 µl human FVIII deficient plasma and then 50l of aPTT reagent. The mixture was incubated at 37° C. for 4 min, and following incubation, 50 µl of $CaCl_2$ was added to the mixture, and the clotting time was measured immediately.

To determine test samples FVIII activity, the clotting time of the standards were plotted using semi-log scale (Clotting time: Linear; Standard concentration: Log) to extrapolates the equation between clotting time and FVIII activity, and FVIII-XTEN activity was then calculated against the standard curve. The assay sensitivity was 40 mU/mL factor VIII.

Results:

The results are summarized in FIGS. 44-46. When single XTEN of 144 or 288 amino acids were inserted into the FVIII, all of the FVIII-XTEN fusion proteins exhibiting activity in the chromogenic assay were also active in aPTT assay. The aPTT activity followed the trend of chromogenic assay, for example, those molecules that showed low FVIII activity in the chromogenic assay also had low aPTT values. Generally, the aPTT results for the fusion proteins were lower than those obtained by the chromogenic assay, with a chromogenic to aPTT ratio of 1.1 up to 2.2, as illustrated in FIG. 44, for the single XTEN insertions. The FVIII-XTEN fusion proteins with multiple XTEN insertions, in general, showed further reductions in aPTT activity in comparison to chromogenic assay. Assays of FVIII-XTEN with two XTEN insertions showed activity with all constructs, but with chromogenic/aPTT ratios approaching 4, in some instances (FIG. 45). Assays of FVIII-XTEN with some three XTEN insertions also showed activity in both assays, with chromogenic/aPTT ratios approaching 5, in some instances (FIG. 46), while the ratios for the BDD-FVIII control were more comparable (right side of FIG. 46). Additionally, the site of XTEN insertion appeared to contribute to the differences seen between aPTT and chromogenic activities. For example, while some molecules with 2 XTEN insertions resulted in up to 4-fold lower activity than chromogenic values, the aPTT activity of other FVIII molecules with 2 XTEN were fairly comparable to chromogenic activity (FIG. 45). Some molecules with 3 XTEN insertions showed up to 5-fold lower than chromogenic activities, other FVIII molecules with 3 XTEN have aPTT activity less than 2-fold lower than chromogenic activity (FIG. 45). Under the conditions of the experiment, the results support the conclusion that FVIII-XTEN fusion protein constructs do retain procoagulant activity, but that the chromogenic assay generally provides higher activity levels than that in the aPTT assay system employed in the study.

Example 50: Evaluations of the Effect of XTEN Insertion Site Onf FVIII Half-Life Extension Methods:

Six FVIII-XTEN fusion proteins with single XTEN AG-144 insertions at defined locations were tested in FVIII/VWF DKO mice (as generally described in Example 32) to evaluate the effect of XTEN insertion site on FVIII half-life. Six representative XTEN variants (listed in table 1) with XTEN insertion in either within A1, A2, a3, A3-region1 (A3-R1), A3-region 2 (A3-R2) or at the C-terminus were selected for this study, and BDD-FVIII generated from the base vector was used as the control. FVIII/VWF DKO mice were treated with a single intravenous administration of transient transfection cell culture media concentrate from the six FVIII-XTEN constructs (or positive control media) at 100-200 IU/kg, and plasma samples were subsequently collected at 5 min, 7 hours and 16 hours post-dosing. Plasma FVIII activity was tested using the FVIII chromogenic assay and FVIII-XTEN half-life was estimated using the WinNonlin program. The study data are summarized in Table 45 and FIG. 47.

Results:

A significantly longer half-life was observed for all FVIII-XTEN variants tested compared to BDD-FVIII control, but the degree of the half-life increase varied, with the variant with XTEN at the 403 insertion site conferring the least half-life extension at 10-fold (in comparison to control), while the 1900 insertion variant conferred the most half-life extension at 18-fold. The differences of XTEN insertion site on FVIII half-life extension may reflect the roles of different FVIII domains in FVIII clearance in vivo.

TABLE 45

FVIII-XTEN single AG-144 insertion variants PK in FVIII/VWF DKO mice

| Treatment | BDD-FVIII | pSD-050 | pSD-0003 | pSD-0039 | pSD-0010 | pSD-063 | pSD-014 |
| --- | --- | --- | --- | --- | --- | --- | --- |
| Insertion site | None | 26 | 403 | 1656 | 1720 | 1900 | CT |
| Recovery | 21.3 | 33.8 | 34.8 | 36.0 | 33.6 | 39.6 | 32.4 |
| t1/2 (hr) | 0.25 | 3.15 | 2.4 | 3.3 | 4.28 | 4.54 | 3.91 |
| t1/2 Increase (fold) | | 13 | 10 | 13 | 17 | 18 | 16 |

Example 51: Evaluations of the Additive Effect of XTEN iIsertions on FVIII Half-Life Extension Methods:

To evaluate the effects of multiple XTEN insertions on FVIII-XTEN fusion protein half-life, the half-lives of FVIII-XTEN variants with 1-3 XTEN insertions were determined in FVIII-XTEN DKO mice using the cell culture concentrate from five constructs (as generally described in Example 32). Five FVIII-XTEN variants were tested in the study: pSD-062, with AE144 insertion at position 1900 (numbered relative to full-length factor VIII); pSD-0005 with AE144 in the FVIII B domain (B-domain amino acid position 745); pSD-0019 with AE288 at the FVIII C-terminus (CT); LSD0003.006 with AE144 inserted in the B-domain and AE288 inserted at the C-terminus, and LSD0055.021 with three XTEN of AE144, AE144, and AE288 inserted at position 1900, with the B domain and at the C-terminus. The FVIII-XTEN half-life values were estimated using the WinNonlin program.

Results:

The study results are summarized in Table 46, and the PK curves are shown in FIG. 48. The study results clearly demonstrated the additive effect of multiple XTEN insertions on FVIII half-life extension. With single XTEN insertions, the half-life of FVIII was extended from 0.25 hr to 3.2-4.0 hr, a 13 to 16-fold increase. When the B and CT XTEN insertions were combined together, the FVIII half-life was further extended to 10.6 hr, a 42-fold prolongation. Finally, in the case of a third XTEN insertion added at position 1900 to the B/CT construct, the half-life reached 16 hr in the FVIII-VWF DKO mice, a 64-fold increase.

TABLE 46

Additive effect of XTEN insertions on FVIII $t_{1/2}$ in FVIII/VWF DKO mice

| Treatment | BDD-FVIII | pSD-062 | pSD-0005 | pSD-0019 | LSD-0003.006 | LSD-0055.021 |
|---|---|---|---|---|---|---|
| XTEN Insertion site | None | 1900 | B | CT | B/CT | 1900/B/CT |
| Recovery | 21.3 | 35.3 | 44.9 | 33.3 | 39.0 | 37.2 |
| t1/2 (hr) | 0.25 | 3.8 | 3.2 | 4.0 | 10.6 | 16.0 |
| t1/2 Increase (fold) | | 15 | 13 | 16 | 42 | 64 |

Example 52: Evaluation of FVIII-XTEN Interference with the Binding of Anti-FVIII Antibodies Using the Bethesday Assay The ability of XTEN insertions in the FVIII molecule to interfer with binding by pre-existing anti-FVIII antibodies to the FVIII-XTEN fusion protein was evaluated in order to determine their utility in treating patients with anti-FVIII inhibitory antibodies.

Methods:

To assess the binding of anti-FVIII antibodies, two FVIII-XTEN variants (PSD088, with 144 XTEN inserted at the locations of 26/403/1656/1900; and PSD-090, with 144 XTEN inserted at the locations of 26/1656/1720/1900) were tested in comparison with Refacto (a marketed rFVIII) against plasma samples from three hemophilia A patients with factor VIII inhibitors (designated 04-483, 05-505, and GK1838-2079), as well as a sheep anti-FVIII poly-clonal antibody from Affinity Biologicals Inc (F8C-EIA-C). The Bethesda titer of the four anti-FVIII ab against the two FVIII-XTEN variants (pSD-088 and pSD-090) and the Refacto control were determined using modified Bethesda assay methods, detailed as follows. Heat inactivated anti-FVIII antibody samples at various dilutions were incubated with 1 IU/mL of each FVIII variant (diluted in 1× in FVIII chromogenic assay buffer) at a 1:1 ratio. The FVIII/antibody mixtures were then incubated for 2 hours in a 37° C. incubator. After the incubation, the samples were diluted for 10-fold with 1×FVIII chromogenic assay buffer, and 25 µL of diluted mixture were then used for a FVIII chromogenic assay, The percentage of remaining FVIII activity was calculated against the post-incubation activity of a known non-neutralizing sample. Bethesda units were calculated using the following formula: BU=dilution factor X (LN (percent of remaining activity)+6.6438).

Results:

The results are listed in Table 47. Decreased Bethesda unit (BU) titers were observed for all four antibodies when tested against the two FVIII-XTEN variants, in comparison with Refacto. A 5 to 8-fold fold decrease against PSD-088 and a 3 to 5-fold decrease against pSD-090, respectively, were obtained. The inhibition curves against FVIII variants for each antibody were plotted (FIG. 49) and compared to Refacto, and demonstrates a clear left-shift of the inhibition curve for the two FVIII-XTEN molecules, with the pSD-088 FVIII-XTEN variant resulting in a further left-shift compared to pSD-090. These results clearly demonstrate that: 1) both FVIII-XTEN variant fusion proteins are more resistant to pre-existing anti-FVIII inhibitory antibodies than Refacto; and 2) PSD-088 is more resistant to anti-FVIII antibodies than PSD-090, which may provide information useful in determining the differences on the XTEN insertion sites in interferring with the binding of anti-FVIII antibodies. Under the conditions of the experiment, the results provide some support for the potential use of FVIII-XTEN compositions for treating hemophilia A patients with factor VIII inhibitors.

TABLE 47

Anti-FVIII antibody Bethesda titer against FVIII-XTEN variants

| | Anti-FVIII ab. | | | |
|---|---|---|---|---|
| FVIII | 04-483 | 05-505 | GK1838-2079 | F8C-EIA-C |
| pSD-088 (16/403/1656/1900) | 2.5 | 8 | 47 | 57 |
| pSD-090 (26/1656/1720/1900) | 3.4 | 12 | 55 | 96 |
| Refacto | 12 | 66 | 268 | 337 |

Example 53: Half-Life Evaluations of FVIII XTEN Fusion Molecules Containing Four XTEN Insertions in Hemophilia A Mice Methods:

Eight FVIII-XTEN fusion proteins with four XTEN insertions each at defined locations were tested in FVIII/VWF DKO mice to evaluate the effect of the XTEN insertions on FVIII half-life extension: LSD0071.001, contains 403-AG144, 1900-AE144, 745 (B)-AE144, 2332 (CT)-AE288 XTEN insertions (designated as the FVIII amino acid number and the XTEN inserted); LSD0071.002, containing 403-AE144, 1900-AE144, 745(B)-AE144, 2332(CT)-AE288 XTEN insertions; LSD0072.001, containing 403-AG144, 1900-AG144, 745(B)-AE144, 2332(CT)-AE288 XTEN insertions; LSD0072.002, containing 403-AE144, 1900-AG144, 745(B)-AE144, 2332(CT)-AE288 XTEN insertions; pBC0247.004, containing 18-AG144, 403-AE144, 1656-AG144, 2332(CT)-AE288 XTEN insertions; pBC0251.002, containing 18-AG144, 1656-AG144, 1900-AE144, 2332(CT)-AE288 XTEN insertions; pSD088, containing 26-AG144, 403-AE144, 1656)-AG144, 1900-AE144 XTEN insertions and pSD090, containing 26-AG144, 1656-Ag144, 1720-AG144, 1900-AE144 XTEN insertions. FVIII/VWF DKO mice were treated, as generally described in Example 32, with a single intravenous administration of FVIII-XTEN transfection cell media concentrate of the eight constructs at 100-200 IU/kg, and plasma samples were subsequently collected at 5 min, 8 hrs, 24 hrs, 48 hrs, 72 hrs and 96 hrs post-dosing. Plasma FVIII activity was tested using the FVIII chromogenic assay and FVIII-XTEN half-life was estimated using the WinNonlin program.

Results:

All of the eight FVIII XTEN fusion molecules containing four XTEN insertions exhibited longer half-life than unmodified FVIII (results in Table 48). Three molecules with XTEN insertions at positions 403, 1900, B domain, and C-terminal achieved half-life up to 16.3 hrs, which is a 65-fold improvement in comparison to unmodified BDD FVIII. However, the molecules tested with XTEN insertions at 26/403/1656/1900 (pSD088), or at 26/1656/1720/1900 (pSD090) showed half-life of 9.1 hrs and 9.5 hrs, respectively, which, in comparison to BDD FVIII, represents an increase of 36-fold and 38-fold, respectively. pBC247.004 (XTEN insertions at 18/403/1656/CT) and pBC251.002 (XTEN insertions at 18/1900/1656/CT) achieved half-life values of 14.1 hrs and 13 hrs, respectively. The results demonstrate that multiple XTEN insertions (in this case, four XTEN insertions for each FVIII molecule) can significantly improve FVIII half-life. It further shows that the effect of XTEN on FVIII half-life is insertion site dependent, even in the event of multiple XTEN insertions.

TABLE 48

PK of FVIII-XTEN variants with four XTEN insertions in FVIII/VWF DKO mice

| Treatment | XTEN Insertions | t1/2 (hr) | t1/2 Increase (fold) |
| --- | --- | --- | --- |
| BDD-FVIII | None | 0.25 | NA |
| LSD0071.001 | 403AG/1900AE/B/CT | 16.2 | 64.8 |
| LSD0071.002 | 403AE/1900AE/B/CT | 16.3 | 65.2 |
| LSD0072.001 | 403AG/1900AG/B/CT | 11.8 | 47.2 |
| LSD0072.002 | 403AE/1900AG/B/CT | 16.1 | 64.4 |
| pBC247.004 | 18/403/1656/CT | 14.1 | 56.4 |
| pBC251.002 | 18/1900/1656/CT | 13.0 | 52 |
| pSD088 | 26/403/1656/1900 | 9.1 | 36.4 |
| pSD090 | 26/1656/1720/1900 | 9.5 | 38 |

TABLE 49

Exemplary Biological Activity, Exemplary Assays and Preferred Indications

| Biologically Active Protein | Biological Activity | Exemplary Activity Assays | Preferred Indication: |
| --- | --- | --- | --- |
| Factor VIII (Factor VIII; Octocog alfa; Moroctocog alfa; Recombinant Antihemophilic factor; Nordiate; ReFacto; Kogenate; Kogenate SF; Helixate; Recombinate) | Coagulation factor VIII is a factor essential for hemostasis. This gene encodes coagulation factor VIII, which participates in the intrinsic pathway of blood coagulation; factor VIII is a cofactor for factor IXa which, in the presence of Ca + 2 and phospholipids, converts factor X to the activated form Xa. This gene produces two alternatively spliced transcripts. Transcript variant 1 encodes a large glycoprotein, isoform a, which circulates in plasma and associates with von Willebrand factor in a noncovalent complex. This protein undergoes multiple cleavage events. Transcript variant 2 encodes a puntative small protein, isoform b, which consists primarily of the phospholipid binding domain of factor VIIIc. This binding domain is essential for coagulant activity. Defects in this gene results in hemophilia A, a common recessive X-linked coagulation disorder. | Chromogenix assay (Rosen S, Scand J Haematol (1984) 33 (Suppl 40): 139-45); Chromogenix Coamatic ® Factor VIII assay; one-stage clotting assay (Lethagen, S. , et al. , Scandinavian J Haematology (1986) 37: 448-453. One-stage clotting assay and two-stage clotting assay (Barrowcliffe TW, Semin Thromb Hemost. (2002) 28(3): 247-256); Development of a simple chromogenic factor VIII assay for clinical use. (Wagenvoord RJ, Hendrix HH, Hemker HC. Haemostasis 1989; 19(4): 196-204) Bethesda assay (Verbruggen B, et al. Improvements in factor VIII inhibitor detection: From Bethesda to Nijmegen. Semin Thromb Hemost. 2009 Nov; 35(8): 752-759) | Hemophilia A; bleeding; Factor VIII deficiency; bleeding episodes in patients with factor VIII inhibitor; Surgery-related hemorrhagic episodes |

TABLE 50

Exemplary CFXTEN comprising FVIII and internal/external XTEN sequences (SEQ ID NOS 1537-1554, respectively, in order of appearance)

| CFXTEN Name | Amino AcidSequence |
| --- | --- |
| FVIII BDD2 (A1-K127- AE144- V128-N745- AE288- P1640- Y2332) | ATRRYYLGAVELSWDYMQSDLGELPVDARFPPRVPKSFPFNTSVVYKKTLFVEFTVHLFNI AKPRPPWMGLLGPTIQAEVYDTVVITLKNMASHPVSLHAVGVSYWKASEGAEYDDQTSQ REKEDDKGGSEPATSGSETPGTSESATPESGPGSEPATSGSETPGSPAGSPTSTEEGTSTEPSE GSAPGSEPATSGSETPGSEPATSGSETPGSEPATSGSETPGTSTEPSEGSAPGTSESATPESGPG SEPATSGSETPGTSTEPSEGSAPGVFPGGSHTYVWQVLKENGPMASDPLCLTYSYLSHVDL VKDLNSGLIGALLVCREGSLAKEKTQTLHKFILLFAVFDEGKSWHSETKNSLMQDRDAASA RAWPKMHTVNGYVNRSLPGLIGCHRKSVYWHVIGMGTTPEVHSIFLEGHTFLVRNHRQAS LEISPITFLTAQTLLMDLGQFLLFCHISSHQHDGMEAYVKVDSCPEEPQLRMKNNEEAEDYD |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | DDLTDSEMDVVRFDDDNSPSFIQIRSVAKKHPKTWVHYIAAEEEDWDYAPLVLAPDDRSY<br>KSQYLNNGPQRIGRKYKKVRFMAYTDETFKTREAIQHESGILGPLLYGEVGDTLLIIFKNQA<br>SRPYNIYPHGITDVRPLYSRRLPKGVKHLKDFPILPGEIFKYKWTVTVEDGPTKSDPRCLTRY<br>YSSFVNMERDLASGLIGPLLICYKESVDQRGNQIMSDKRNVILFSVFDENRSWYLTENIQRF<br>LPNPAGVQLEDPEFQASNIMHSINGYVFDSLQLSVCLHEVAYWYILSIGAQTDFLSVFFSGY<br>TFKHKMVYEDTLTLFPFSGETVFMSMENPGLWILGCHNSDFRNRGMTALLKVSSCDKNTG<br>DYYEDSYEDISAYLLSKNNAIEPRSFSQNGGTSESATPESGPGSEPATSGSETPGTSESATPES<br>GPGSEPATSGSETPGTSESATPESGPGTSTEPSEGSAPGSPAGSPTSTEEGTSESATPESGPGSE<br>PATSGSETPGTSESATPESGPGSPAGSPTSTEEGSPAGSPTSTEEGTSTEPSEGSAPGTSESATP<br>ESGPGTSESATPESGPGTSESATPESGPGSEPATSGSETPGSEPATSGSETPGSPAGSPTSTEEG<br>TSTEPSEGSAPGTSTEPSEGSAPGSEPATSGSETPGTSESATPESGPGTSTEPSEGSAPGPPVLK<br>RHQREITRTTLQSDQEEIDYDDTISVEMKKEDFDIYDEDENQSPRSFQKKTRHYFIAAVERL<br>WDYGMSSSPHVLRNRAQSGSVPQFKKVVFQEFTDGSFTQPLYRGELNEHLGLLGPYIRAEV<br>EDNIMVTFRNQASRPYSFYSSLISYEEDQRQGAEPRKNFVKPNETKTYFWKVQHHMAPTK<br>DEFDCKAWAYFSDVDLEKDVHSGLIGPLLVCHTNTLNPAHGRQVTVQEFALFFTIFDETKS<br>WYFTENMERNCRAPCNIQMEDPTFKENYRFHAINGYIMDTLPGLVMAQDQRIRWYLLSMG<br>SNENIHSIHFSGHVFTVRKKEEYKMALYNLYPGVFETVEMLPSKAGIWRVECLIGEHLHAG<br>MSTLFLVYSNKCQTPLGMASGHIRDFQITASGQYGQWAPKLARLHYSGSINAWSTKEPFSW<br>IKVDLLAPMIIHGIKTQGARQKFSSLYISQFIIMYSLDGKKWQTYRGNSTGTLMVFFGNVDS<br>SGIKHNIFNPPIIARYIRLHPTHYSIRSTLRMELMGCDLNSCSMPLGMESKAISDAQITASSYF<br>TNMFATWSPSKARLHLQGRSNAWRPQVNNPKEWLQVDFQKTMKVTGVTTQGVKSLLTS<br>MYVKEFLISSSQDGHQWTLFFQNGKVKVFQGNQDSFTPVVNSLDPPLLTRYLRIHPQSWVH<br>QIALRMEVLGCEAQDLY |
| FVIII BDD2<br>(A1-A375-<br>AE576-<br>K376-N745-<br>AE144-<br>P1640-<br>Y2332) | ATRRYYLGAVELSWDYMQSDLGELPVDARFPPRVPKSFPFNTSVVYKKTLFVEFTVHLFNI<br>AKPRPPWMGLLGPTIQAEVDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMTTPEVHSIFLEGHTFLVRNHRQASLEISPITFLTAQTLLMD<br>LGQFLLFCHISSHQHDGMEAYVKVDSCPEEPQLRMKNNEEAEDYDDDLTDSEMDVVRFDD<br>DNSPSFIQIRSVAGGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSEPATSGSETPGSPAGSPT<br>STEEGTSESATPESGPGTSTEPSEGSAPGTSTEPSEGSAPGSPAGSPTSTEEGTSTEPSEGSAPG<br>TSTEPSEGSAPGTSESATPESGPGTSTEPSEGSAPGTSESATPESGPGSEPATSGSETPGTSTEP<br>SEGSAPGTSTEPSEGSAPGTSESATPESGPGTSESATPESGPGSPAGSPTSTEEGTSESATPESG<br>PGSEPATSGSETPGTSESATPESGPGTSTEPSEGSAPGTSTEPSEGSAPGTSTEPSEGSAPGT<br>EPSEGSAPGTSTEPSEGSAPGSPAGSPTSTEEGSTEPSEGSAPGTSTSESATPE<br>SGPGSEPATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPGTSTEPS<br>EGSAPGKKHPKTWVHYIAAEEEDWDYAPLVLAPDDRSYKSQYLNNGPQRIGRKYKKVRF<br>MAYTDETFKTREAIQHESGILGPLLYGEVGDTLLIIFKNQASRPYNIYPHGITDVRPLYSRRL<br>PKGVKHLKDFPILPGEIFKYKWTVTVEDGPTKSDPRCLTRYYSSFVNMERDLASGLIGPLLI<br>CYKESVDQRGNQIMSDKRNVILFSVFDENRSWYLTENIQRFLPNPAGVQLEDPEFQASNIM<br>HSINGYVFDSLQLSVCLHEVAYWYILSIGAQTDFLSVFFSGYTFKHKMVYEDTLTLFPFSGE<br>TVFMSMENPGLWILGCHNSDFRNRGMTALLKVSSCDKNTGDYYEDSYEDISAYLLSKNNA<br>IEPRSFSQNGGSEPATSGSETPGTSESATPESGPGSEPATSGSETPGSPAGSPTSTEEGTSTEPS<br>EGSAPGSEPATSGSETPGSEPATSGSETPGSEPATSGSETPGTSTEPSEGSAPGTSESATPESGP<br>GSEPATSGSETPGTSTEPSEGSAPGPPVLKRHQREITRTTLQSDQEEIDYDDTISVEMKKEDF<br>DIYDEDENQSPRSFQKKTRHYFIAAVERLWDYGMSSSPHVLRNRAQSGSVPQFKKVVFQEF<br>TDGSFTQPLYRGELNEHLGLLGPYIRAEVEDNIMVTFRNQASRPYSFYSSLISYEEDQRQGA<br>EPRKNFVKPNETKTYFWKVQHHMAPTKDEFDCKAWAYFSDVDLEKDVHSGLIGPLLVCH<br>TNTLNPAHGRQVTVQEFALFFTIFDETKSWYFTENMERNCRAPCNIQMEDPTFKENYRFHA<br>INGYIMDTLPGLVMAQDQRIRWYLLSMGSNENIHSIHFSGHVFTVRKKEEYKMALYNLYPG<br>VFETVEMLPSKAGIWRVECLIGEHLHAGMSTLFLVYSNKCQTPLGMASGHIRDFQITASGQ<br>YGQWAPKLARLHYSGSINAWSTKEPFSWIKVDLLAPMIIHGIKTQGARQKFSSLYISQFIIMY<br>SLDGKKWQTYRGNSTGTLMVFFGNVDSSGIKHNIFNPPIIARYIRLHPTHYSIRSTLRMELM<br>GCDLNSCSMPLGMESKAISDAQITASSYFTNMFATWSPSKARLHLQGRSNAWRPQVNNPK<br>EWLQVDFQKTMKVTGVTTQGVKSLLTSMYVKEFLISSSQDGHQWTLFFQNGKVKVFQGN<br>QDSFTPVVNSLDPPLLTRYLRIHPQSWVHQIALRMEVLGCEAQDLY |
| FVIII BDD2<br>(A1-Y1792-<br>AP144-<br>E1793-<br>Y2332-<br>AE864) | ATRRYYLGAVELSWDYMQSDLGELPVDARFPPRVPKSFPFNTSVVYKKTLFVEFTVHLFNI<br>AKPRPPWMGLLGPTIQAEVDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMTTPEVHSIFLEGHTFLVRNHRQASLEISPITFLTAQTLLMD<br>LGQFLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKY<br>KKVRFMAYTDETFKTREAIQHESGILGPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSQNPPVLKRHQREITRTTLQSDQEEIDYDDTISVEMKKEDFDIYDEDENQSPR<br>SFQKKTRHYFIAAVERLWDYGMSSSPHVLRNRAQSGSVPQFKKVVFQEFTDGSFTQPLYRG |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | ELNEHLGLLGPYIRAEVEDNIMVTFRNQASRPYSFYSSLISYGGTSTPESGSASPGTSPSGESS<br>TAPGTSPSGESSTAPGSTSSTAESPGPGSTSESPSGTAPGSTSSTAESPGPGTSPSGESSTAPGT<br>STPESGSASPGSTSSTAESPGPGTSPSGESSTAPGTSPSGESSTAPGTSPSGESSTAPGEEDQRQ<br>GAEPRKNFVKPNETKTYFWKVQHHMAPTKDEFDCKAWAYFSDVDLEKDVHSGLIGPLLV<br>CHTNTLNPAHGRQVTVQEFALFFTIFDETKSWYFTENMERNCRAPCNIQMEDPTFKENYRF<br>HAINGYIMDTLPGLVMAQDQRIRWYLLSMGSNENIHSIHFSGHVFTVRKKEEYKMALYNL<br>YPGVFETVEMLPSKAGIWRVECLIGEHLHAGMSTLFLVYSNKCQTPLGMASGHIRDFQITA<br>SGQYGQWAPKLARLHYSGSINAWSTKEPFSWIKVDLLAPMIIHGIKTQGARQKFSSLYISQFI<br>IMYSLDGKKWQTYRGNSTGTLMVFFGNVDSSGIKHNIFNPPIIARYIRLHPTHYSIRSTLRME<br>LMGCDLNSCSMPLGMESKAISDAQITASSYFTNMFATWSPSKARLHLQGRSNAWRPQVNN<br>PKEWLQVDFQKTMKVTGVTTQGVKSLLTSMYVKEFLISSSQDGHQWTLFFQNGKVKVFQ<br>GNQDSFTPVVNSLDPPLLTRYLRIHPQSWVHQIALRMEVLGCEAQDLYGGSPAGSPTSTEE<br>GTSESATPESGPGTSTEPSEGSAPGSPAGSPTSTEEGTSTEPSEGSAPGTSTEPSEGSAPGTSES<br>ATPESGPGSEPATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSTEPSEGSAPGTSESATPESGPGTS<br>TEPSEGSAPGTSESATPESGPGSEPATSGSETPGTSTEPSEGSAPGTSTEPSEGSAPGTSESATP<br>ESGPGTSESATPESGPGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGTSTEP<br>SEGSAPGSPAGSPTSTEEGTSTEPSEGSAPGTSESATPESGPGSEPATSGSETPGTSESATPESG<br>PGSEPATSGSETPGTSESATPESGPGTSTEPSEGSAPGTSESATPESGPGSPAGSPTSTEEGSPA<br>GSPTSTEEGSPAGSPTSTEEGTSESATPESGPGTSTEPSEGSAPGTSESATPESGPGSEPATSGS<br>ETPGTSESATPESGPGSEPATSGSETPGTSESATPESGPGTSTEPSEGSAPGSPAGSPTSTEEGT<br>SESATPESGPGSEPATSGSETPGTSESATPESGPGSPAGSPTSTEEGSPAGSPTSTEEGTSTEPS<br>EGSAPGTSESATPESGPGTSESATPESGPGTSESATPESGPGSEPATSGSETPGSEPATSGSETP<br>GSPAGSPTSTEEGTSTEPSEGSAPGTSTEPSEGSAPGSEPATSGSETPGTSESATPESGPGTSTE<br>PSEGSAP |
| FVIII BDD2<br>(A1-Y2043-<br>AG144-<br>G2044-<br>Q2222-<br>AG864-<br>V2223-<br>Y2332) | ATRRYYLGAVELSWDYMQSDLGELPVDARFPPRVPKSFPFNTSVVYKKTLFVEFTVHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMGTTPEVHSIFLEGHTFLVRNHRQASLEISPITFLTAQTLLMD<br>LGQFLLFCHISSSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKY<br>KKVRFMAYTDETFKTREAIQHESGILGPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSQNPPVLKRHQREITRTTLQSDQEEIDYDDTISYMKKEDFDIYDEDENQSPR<br>SFQKKTRHYFIAAVERLWDYGMSSSPHVLRNRAQSGSVPQFKKVVFQEFTDGSFTQPLYRG<br>ELNEHLGLLGPYIRAEVEDNIMVTFRNQASRPYSFYSSLISYEEDQRQGAEPRKNFVKPNET<br>KTYFWKVQHHMAPTKDEFDCKAWAYFSDVDLEKDVHSGLIGPLLVCHTNTLNPAHGRQV<br>TVQEFALFFTIFDETKSWYFTENMERNCRAPCNIQMEDPTFKENYRFHAINGYIMDTLPGLV<br>MAQDQRIRWYLLSMGSNENIHSIHFSGHVFTVRKKEEYKMALYNLYPGVFETVEMLPSKA<br>GIWRVECLIGEHLHAGMSTLFLVYSNKCQTPLGMASGHIRDFQITASGQYGPGSSPSASTGT<br>GPGSSPSASTGTGPGTPGSGTASSSPGSSTPSGATGSPGSSPSASTGTGPGASPGTSSTGSPGT<br>PGSGTASSSPGSSTPSGATGSPGTPGSGTASSSPGASPGTSSTGSPGASPGTSSTGSPGTPGSG<br>TASSSGGQWAPKLARLHYSGSINAWSTKEPFSWIKVDLLAPMIIHGIKTQGARQKFSSLYIS<br>QFIIMYSLDGKKWQTYRGNSTGTLMVFFGNVDSSGIKHNIFNPPIIARYIRLHPTHYSIRSTLR<br>MELMGCDLNSCSMPLGMESKAISDAQITASSYFTNMFATWSPSKARLHLQGRSNAWRPQG<br>GASPGTSSTGSPGSSPSASTGTGPGSSPSASTGTGPGTPGSGTASSSPGSSTPSGATGSPGSSPS<br>ASTGTGPGASPGTSSTGSPGTPGSGTASSSPGSSTPSGATGSPGTPGSGTASSSPGASPGTSST<br>GSPGASPGTSSTGSPGTPGSGTASSSPGSSTPSGATGSPGASPGTSSTGSPGTPGSGTASSSPG<br>SSTPSGATGSPGSSPSASTGTGPGSSPSASTGTGPGSSTPSGATGSPGSSTPSGATGSPGASPG<br>TSSTGSPGASPGTSSTGSPGASPGTSSTGSPGTPGSGTASSSPGASPGTSSTGSPGASPGTSSTG<br>SPGASPGTSSTGSPGSSPSASTGTGPGTPGSGTASSSPGTSSTGSPGA<br>SPGTSSTGSPGSSTPSGATGSPGSSTPSGATGSPGSSPSASTGTGPGASPGTSSTGSPGASPGTSSTGS<br>PGTPGSGTASSSPGASPGTSSTGSPGASPGTSSTGSPGASPGTSSTGSPGASPGTSSTGSPGTP<br>GSGTASSSPGSSTPSGATGSPGTPGSGTASSSPGSSTPSGA<br>TGSPGSSTPSGATGSPGSSPSASTGTGPGSSPSASTGTGPGASPGTSSTGSPGTPGSGTASSS<br>PGSSTPSGATGSPGSSPSASTGTGPGSSPSASTGTGPGASPGTSSTGSPGASPGTSSTGSPGSST<br>PSGATGSPGSSPSASTGTGPGASPGTSSTGSPGSSPSASTGTGPGTPGSGTASSSPGSSTPSGA<br>TGSPGSSTPSGATGSPGASPGTSSTGSPGVNNPKEWLQVDFQKTMKVTGVTTQGVKSLLTS<br>MYVKEFLISSSQDGHQWTLFFQNGKVKVFQGNQDSFTPVVNSLDPPLLTRYLRIHPQSWVH<br>QIALRMEVLGCEAQDLY |
| FVIII BDD2<br>(A1-G1799-<br>AE144-<br>A1800-<br>F2093-<br>AE42- | ATRRYYLGAVELSWDYMQSDLGELPVDARFPPRVPKSFPFNTSVVYKKTLFVEFTVHLFN<br>IAKPRPPWMGLLGPTIQAEVYDTVVITLKNMASHPVSLHAVGVSYWKASEGAEYDDQTS<br>QREKEDDKVFPGGSHTYVWQVLKENGPMASDPLCLTYSYLSHVDLVKDLNSGLIGALLV<br>CREGSLAKEKTQTLHKFILLFAVFDEGKSWHSETKNSLMQDRDAASARAWPKMHTVNGY<br>VNRSLPGLIGCHRKSVYWHVIGMGTTPEVHSIFLEGHTFLVRNHRQASLEISPITFLTAQTL<br>LMDLGQFLLFCHISSSHQHDGMEAYVKVDSCPEEPQLRMKNNEEAEDYDDDLTDSEMDVV |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| S2094-<br>V2223-<br>AE42-<br>N2224-<br>AE42-<br>N2225-<br>G2278-<br>AE42-<br>K2279-<br>Y2332) | RFDDDNSPSFIQIRSVAKKHPKTWVHYIAAEEEDWDYAPLVLAPDDRSYKSQYLNNGPQR<br>IGRKYKKVRFMAYTDETFKTREAIQHESGILGPLLYGEVGDTLLIIFKNQASRPYNIYPHGIT<br>DVRPLYSRRLPKGVKHLKDFPILPGEIFKYKWTVTVEDGPTKSDPRCLTRYYSSFVNMERD<br>LASGLIGPLLICYKESVDQRGNQIMSDKRNVILFSVFDENRSWYLTENIQRFLPNPAGVQLE<br>DPEFQASNIMHSINGYVFDSLQLSVCLHEVAYWYILSIGAQTDFLSVFFSGYTFKHKMVYE<br>DTLTLFPFSGETVFMSMENPGLWILGCHNSDFRNRGMTALLKVSSCDKNTGDYYEDSYED<br>ISAYLLSKNNAIEPRSFSQNPPVLKRHQREITRTTLQSDQEEIDYDDTISVEMKKEDFDIYDE<br>DENQSPRSFQKKTRHYFIAAVERLWDYGMSSSPHVLRNRAQSGSVPQFKKVVFQEFTDGS<br>FTQPLYRGELNEHLGLLGPYIRAEVEDNIMVTFRNQASRPYSFYSSLISYEEDQRQGGGSEP<br>ATSGSETPGTSESATPESGPGSEPATSGSETPGSPAGSPTSTEEGTSTEPSEGSAPGSEPATSG<br>SETPGSEPATSGSETPGSEPATSGSETPGTSTEPSEGSAPGTSESATPESGPGSEPATSGSETP<br>GTSTEPSEGSAPGAEPRKNFVKPNETKTYFWKVQHHMAPTKDEFDCKAWAYFSDVDLEK<br>DVHSGLIGPLLVCHTNTLNPAHGRQVTVQEFALFFTIFDETKSWYFTENMERNCRAPCNIQ<br>MEDPTFKENYRFHAINGYIMDTLPGLVMAQDQRIRWYLLSMGSNENIHSIHFSGHVFTVR<br>KKEEYKMALYNLYPGVFETVEMLPSKAGIWRVECLIGEHLHAGMSTLFLVYSNKCQTPL<br>GMASGHIRDFQITASGQYGQWAPKLARLHYSGSINAWSTKEPFSWIKVDLLAPMIIHGIKT<br>QGARQKFDSEPATSGSETPGTSESATPESGPGTSTEPSEGSAPGSPAGSPGSSLYISQFIIMYS<br>LDGKKWQTYRGNSTGTLMVFFGNVDSSGIKHNIFNPPIIARYIRLHPTHYSIRSTLRMELMG<br>CDLNSCSMPLGMESKAISDAQITASSYFTNMFATWSPSKARLHLQGRSNAWRPQVGPAGS<br>PTSTEEGTSTEPSEGSAPGTSESATPESGPGSEPATSGGNNPKEWLQVDFQKTMKVTGVTT<br>QGVKSLLTSMYVKEFLISSSQDGHQWTLFFQNGGTEPSEGSAPGSPAGSPTSTEEGTSESAT<br>PESGPGSEPATSGSKVKVFQGNQDSFTPVVNSLDPPLLTRYLRIHPQSWVHQIALRMEVLG<br>CEAQDLY |
| FVIII BDD2<br>(A1-R28-<br>AG144-F29-<br>G244-<br>AG288-<br>L245-<br>R2090-<br>AG576-<br>Q2091-<br>Y2332-<br>AG864) | ATRRYYLGAVELSWDYMQSDLGELPVDARGPGSSPSASTGTGPGSSPSASTGTGPGTPGSG<br>TASSSPGSSTPSGATGSPGSSPSASTGTGPGASPGTSSTGSPGTPGSGTASSSPGSSTPSGATGS<br>PGTPGSGTASSSPGASPGTSSTGSPGASPGTSSTGSPGTPGSGTASSSGFPPRVPKSPFNTSV<br>VYKKTLFVEFTVHLFNIAKPRPPWMGLLGPTIQAEVYDTVVITLKNMASHPVSLHAVGVSY<br>WKASEGAEYDDQTSQREKEDDKVFPGGSHTYVWQVLKENGPMASDPLCLTYSYLSHVDL<br>VKDLNSGLIGALLVCREGSLAKEKTQTLHKFILLFAVFDEGKSWHSETKNSLMQDRDAASA<br>RAWPKMHTVNGYVNRSLPGGPGASPGTSSTGSPGASPGTSSTGSPGTPGSGTASSSPGSSTP<br>SGATGSPGTPGSGTASSSPGSSTPSGATGSPGTPGSGTASSSPGSSTPSGATGSPGSSTPSGAT<br>GSPGSSPSASTGTGPGSSPSASTGTGPGASPGTSSTGSPGTPGSGTASSSPGSSTPSGATGSPG<br>SSPSASTGTGPGSSPSASTGTGPGASPGTSSTGSPGSSTPSGATGSPGSSPSA<br>STGTGPGASPGTSSTGSPGSSPSASTGTGPGTPGSGTASSSPGSSTPSGATGSPGSSPSA<br>STGTGPGASPGTSSTGSPGSSPSASTGTGPGTPGSGTASSSPGSSTPSGATGSGLIGCHRKSVY<br>WHVIGMGTTPEVHSIFLEGHTFLVRNHRQASLEISPITFLTAQTLLMDLGQFLLFCHISSSHQH<br>DGMEAYVKVDSCPEEPQLRMKNNEEAEDYDDDLTDSEMDVVRFDDDNSPSFIQIRSVAKK<br>HPKTWVHYIAAEEEDWDYAPLVLAPDDRSYKSQYLNNGPQRIGRKYKKVRFMAYTDETF<br>KTREAIQHESGILGPLLYGEVGDTLLIIFKNQASRPYNIYPHGITDVRPLYSRRLPKGVKHLK<br>DFPILPGEIFKYKWTVTVEDGPTKSDPRCLTRYYSSFVNMERDLASGLIGPLLICYKESVDQR<br>GNQIMSDKRNVILFSVFDENRSWYLTENIQRFLPNPAGVQLEDPEFQASNIMHSINGYVFDS<br>LQLSVCLHEVAYWYILSIGAQTDFLSVFFSGYTFKHKMVYEDTLTLFPFSGETVFMSMENP<br>GLWILGCHNSDFRNRGMTALLKVSSCDKNTGDYYEDSYEDISAYLLSKNNAIEPRSFSQNP<br>PVLKRHQREITRTTLQSDQEEIDYDDTISVEMKKEDFDIYDEDENQSPRSFQKKTRHYFIAA<br>VERLWDYGMSSSPHVLRNRAQSGSVPQFKKVVFQEF TDGSFTQPLYRGELNEHLGLLGPYI<br>RAEVEDNIMVTFRNQASRPYSFYSSLISYEEDQRQGAEPRKNFVKPNETKTYFWKVQHHM<br>APTKDEFDCKAWAYFSDVDLEKDVHSGLIGPLLVCHTNTLNPAHGRQVTVQEFALFFTIFD<br>ETKSWYFTENMERNCRAPCNIQMEDPTFKENYRFHAGINGYIMDTLPGLVMAQDQRIRWY<br>LLSMGSNENIHSIHFSGHVFTVRKKEEYKMALYNLYPGVFETVEMLPSKAGIWRVECLIGE<br>HLHAGMSTLFLVYSNKCQTPLGMASGHIRDFQITASGQYGQWAPKLARLHYSGSINAWST<br>KEPFSWIKVDLLAPMIIHGIKTQGARGSPAGSPTSTEEGTSESATPESGPGTSTEPSEGSAPGS<br>PAGSPTSTEEGTSTEPSEGSAPGTSTEPSEGSAPGTSESATPESGPGSEPATSGSETPGSEPATS<br>GSETPGSPAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPGTSESATPESGPGSEPA<br>TSGSETPGTSTEPSEGSAPGTSTEPSEGSAPGTSESATPESGPGTSESATPESGPGSPAGSPTST<br>EEGTSESATPESGPGSEPATSGSETPGTSESATPESGPGTSTEPSEGSAPGTSTEPSEGSAPGTS<br>TEPSEGSAPGTSTEPSEGSAPGTSTEPSEGSAPGSPAGSPTSTEEGTSTEPSE<br>GSAPGTSESATPESGPGSEPATSGSETPGTSESATPESGPGSEPATSGSETPGTSESATPESGPG<br>TSTEPSEGSAPGTSESATPESGPGSPAGSPTSTEEGSPAGSPTSTEEGSPAGSPTSTEEGTSESA<br>TPESGPGTSTEPSEGSAPGQKFSSLYISQFIIMYSLDGKKWQTYRGNSTGTLMVFFGNVDSS<br>GIKHNIFNPPIIARYIRLHPTHYSIRSTLRMELMGCDLNSCSMPLGMESKAISDAQITASSYFT<br>NMFATWSPSKARLHLQGRSNAWRPQVNNPKEWLQVDFQKTMKVTGVTTQGVKSLLTSM<br>YVKEFLISSSQDGHQWTLFFQNGKVKVFQGNQDSFTPVVNSLDPPLLTRYLRIHPQSWVHQ<br>IALRMEVLGCEAQDLYGGSPAGSPTSTEEGTSESATPESGPGTSTEPSEGSAPGSPAGSPTST<br>EEGTSTEPSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEGTSTEPSE<br>GSAPGTSTEPSEGSAPGTSESATPESGPGTSTEPSEGSAPGTSESATPESGPGSEPATSGSETPG<br>TSTEPSEGSAPGTSTEPSEGSAPGTSESATPESGPGTSESATPESGPGSPAGSPTSTEEGTSESA<br>TPESGPGSEPATSGSETPGTSESATPESGPGTSTEPSEGSAPGTSTEPSEGSA<br>PGTSTEPSEGSAPGTSTEPSEGSAPGTSTEPSEGSAPGSPAGSPTSTEEGTSTEPSEGSAPGTSE<br>SATPESGPGSEPATSGSETPGTSESATPESGPGSEPATSGSETPGTSESATPESGPGTSTEPSEG<br>SAPGTSESATPESGPGSPAGSPTSTEEGSPAGSPTSTEEGSPAGSPTSTEEGTSESATPESGPGT<br>STEPSEGSAPGTSESATPESGPGSEPATSGSETPGTSESATPESGPGSEPATSGSETPGTSESAT<br>PESGPGTSTEPSEGSAPGSPAGSPTSTEEGTSESATPESGPGSEPATSGSETPGTSESATPESGP |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | GSPAGSPTSTEEGSPAGSPTSTEEGTSTEPSEGSAPGTSESATPESGPGTSESATPESGPGTSES ATPESGPGSEPATSGSETPGSEPATSGSETPGSPAGSPTSTEEGTSTEPSEGSAPGTSTEPSEGS APGSEPATSGSETPGTSESATPESGPGTSTEPSEGSAP |
| FVIII (A1-T1651-AG576-R1652-K1808-AG144-P1809-F2093-AG288-S2094-Y2332) | ATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQ REKEDDKVFPGGSHTYVWQVLKENGPMASDPLCLTYSYLSHVDLVKDLNSGLIGALLVCR EGSLAKEKTQTLHKFILLLFAVFDEGKSWHSETKNSLMQDRDAASARAWPKMHTVNGYVN RSLPGLIGCHRKSVYWHVIGMGTTPEVHSIFLEGHTFLVRNHRQASLEISPITFLTAQTLLMD LGQFLLFCHISSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNNGPQRIGRKY KKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLI GPLLICYKESVDQRGNQIMSDKRNVILFSVFDENRSWYLTENIQRFLPNPAGVQLEDPEFQA SNIMHSINGYVFDSLQLSVCLHEVAYWYILSIGAQTDFLSVFFSGYTFKHKMVYEDTLTLFP FSGETVFMSMENPGLWILGCHNSDFRNRGMTALLKVSSCDKNTGDYYEDSYEDISAYLLS KNNAIEPRSFSQNSRHPSTRQKQFNATTIPENDIEKTDPWFAHRTPMPKIQNVSSSDLLMLLR QSPTPHGLSLSDLQEAKYETFSDDPSPGAIDSNNSLSEMTHFRPQLHHSGDMVFTPESGLQL RLNEKLGTTAATELKKLDFKVSSTSNNLISTIPSDNLAAGTDNTSSLGPPSMPVHYDSQLDT TLFGKKSSPLTESGGPLSLSEENNDSKLLESGLMNSQESSWGKNVSSTESGRLFKGKRAHGP ALLTKDNALFKVSISLLKTNKTSNNSATNRKTHIDGPSLLIENSPSVWQNILESDTEFKKVTP LIHDRMLMDKNATALRLNHMSNKTTSSKNMEMVQQKKEGPIPPDAQNPDMSFFKMLFLPE SARWIQRTHGKNSLNSGQGPSPKQLVSLGPEKSVEGQNFLSEKNKVVVGKGEFTKDVGLK EMVFPSSRNLFLTNLDNLHENNTHNQEKKIQEEIEKKETLIQENVVLPQIHTVTGTKNFMKN LFLLSTRQNVEGSYDGAYAPVLQDFRSLNDSTNRTKKHTAHFSKKGEEENLEGLGNQTKQI VEKYACTTRISPNTSQQNFVTQRSKRALKQFRLPLEETELEKRIIVDDTSTQWSKNMKHLTP STLTQIDYNEKEKGAITQSPLSDCLTRSHSIPQANRSPLPIAKVSSPSIRPIYLTRVLFQDNSS HLPAASYRKKDSGVQESSHFLQGAKKNNLSLAILTLEMTGDQREVGSLGTSATNSVTYKK VENTVLPKPDLPKTSGKVELLPKVHIYQKDLFPTETSNGSPGHLDLVEGSLLQGTEGAIKWN EANRPGKVPFLRVATESSAKTPSKLLDPLAWDNHYGTQIPKEEWKSQEKSPEKTAFKKKDT ILSLNACESNHAIAAINEGQNKPEIEVTWAKQGRTERLCSQNPPVLKRHQREITGPGTPGSGT ASSSPGSSTPSGATGSPGSSPSASTGTGPGSSPSASTGTGPGSSPSASTGSPGSSTPSGATGSP GASPGTSSTGSPGASPGTSSTGSPGASPGTSSTGPGTPGSGTASSSPGASPGTSSTGSPGASP GTSSTGSPGASPGTSSTGSPGSSPSASTGTGPGTPGSGTASSSPGASPGTSSTGSPGASPGTSST GSPGASPGTSSTGSPGSSTPSGATGSPGSSTPSGATGSPGASPGTSSTGSPGTPGSGTASSSPG SSTPSGATGSPGSSTPSGATGSPGSSTPSGATGSPGASPGTSSTGPGASPGTSSTGSPGASP TSSTGSPGTPGSGTASSSPGASPGTSSTGSPGASPGTSSTGSPGASPGTSSTGSPGASPGTSSTG SPGTPGSGTASSSPGSSTPSGATGSPGTPGSGTASSSPGSSTPSGATGSPGTPGSGTASSSPGSS TPSGATGSPGSSTPSGATGSPGSSPSASTGTGPGSSPSASTGTGPGASPGTSSTGSPGTPGSGT ASSSPGSSTPSGATGSPGSSPSASTGTGPGSSPSASTGTGPGASPGTSSTGSSGRTTLQSDQEEI DYDDTISVEMKKEDFDIYDEDENQSPRSFQKKTRHYFIAAVERLWDYGMSSSPHVLRNRA QSGSVPQFKKVVFQEFTDGSFTQPLYRGELNEHLGLLGPYIRAEVEDNIMVTFRNQASRPYS FYSSLISYEEDQRQGAEPRKNFVKGSGTASSSPGSSTPSGATGSPGTPGSGTASSSPGSSTPSG ATGSPGSSTPSGATGSPGSSTPSGATGSPGSSTPSGATGSPGASPGTSSTGSPGTPGSGTASSS PGSSTPSGATGSPGSSPSASTGTGPGSSPSASTGTGPGASPGPNETKTYFWKVQHHMAPTKD EFDCKAWAYFSDVDLEKDVHSGLIGPLLVCHTNTLNPAHGRQVTVQEFALFFTIFDETKSW YFTENMERNCRAPCNIQMEDPTFKENYRFHAINGYIMDTLPGLVMAQDQRIRWYLLSMGS NENIHSIHFSGHVFTVRKKEEYKMALYNLYPGVFETVEMLPSKAGIWRVECLIGEHLHAGM STLFLVYSNKCQTPLGMASGHIRDFQITASGQYGQWAPKLARLHYSGSINAWSTKEPFSWI KVDLLAPMIIHGIKTQGARQKFGPGASPGTSSTGSPGASPGTSSTGSPGTPGSGTASSSPGSST PSGATGSPGTPGSGTASSSPGSSTPSGATGSPGTPGSGTASSSPGSSTPSGATGSPGSSTPSGA TGSPGSSPSASTGTGPGSSPSASTGTGPGASPGTSSTGSPGASPGTSSTGSPGSSTPSGATGSP GSSSPSASTGTGPGASPGTSSTGSPGSSPSASTGTGPGTPGSGTASSSPGSSTPSGATGSGSSLYISQFII MYSLDGKKWQTYRGNSTGTLMVFFGNVDSSGIKHNIFNPPIIARYIRLHPTHYSIRSTLRME LMGCDLNSCSMPLGMESKAISDAQITASSYFTNMFATWSPSKARLHLQGRSNAWRPQVNN PKEWLQVDFQKTMKVTGVTTQGVKSLLTSMYVKEFLISSSQDGHQWTLFFQNGKVKVFQ GNQDSFTPVVNSLDPPLLTRYLRIHPQSWVHQIALRMEVLGCEAQDLY |
| FVIII BDD2 (A1-A28-AG42-F29-E124-AG42-D125-E124-AG42-D125-P333-AG42-Q334-Y2332) | ATRRYYLGAVELSWDYMQSDLGELPVDAGGAPSPSASTGTGPGTPGSGTASSSPGSSTPSG ATGSPGPSGPGRFPPRVPKSFPFNTSVVYKKTLFVEFTVHLFNIAKPRPPWMGLLGPTIQAEV YDTVVITLKNMASHPVSLHAVGVSYWKASEGAEYDDQTSQREKEGGPGTPGSGTASSSPG SSTPSGATGSPGSSPSASTGTGPGASPGDDKVFPGGSHTYVWQVLKENGPMASDPLCLTYS YLSHVDLVKDLNSGLIGALLVCREGSLAKEKTQTLHKFILLLFAVFDEGGSPSASTGTGPGAS PGTSSTGSPGTPGSGTASSSPGSSTPSGAGKSWHSETKNSLMQDRDAASARAWPKMHTVN GYVNSSLPGLIGCHRKSVYWHVIGMGTTPEVHSIFLEGHTFLVRNHRQASLEISPITFLTAQT LLMDLGQFLLFCHISSHQHDGMEAYVKVDSCPEEPGSASTGTGPGASPGTSSTGSPGTPGSG TASSSPGSSTPSGATGGQLRMKNNEEAEDYDDDLTDSEMDVVRFDDDNSPSFIQIRSVAKK HPKTWVHYIAAEEEDWDYAPLVLAPDDDRSYKSQYLNNGPQRIGRKYKKVRFMAYTDETF KTREAIQHESGILGPLLYGEVGDTLLIIFKNQASRPYNIYPHGITDVRPLYSRRLPKGVKHLK DFPILPGEIFKYKWTVTVEDGPTKSDPRCLTRYYSSFVNMERDLASGLIGPLLICYKESVDQR GNQIMSDKRNVILFSVFDENRSWYLTENIQRFLPNPAGVQLEDPEFQASNIMHSINGYVFDS LQLSVCLHEVAYWYILSIGAQTDFLSVFFSGYTFKHKMVYEDTLTLFPPSGETVFMSMENP GLWILGCHNSDFRNRGMTALLKVSSCDKNTGDYYEDSYEDISAYLLSKNNAIEPRSFSQNP |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | PVLKRHQREITRTTLQSDQEEIDYDDTISVEMKKEDFDIYDEDENQSPRSFQKKTRHYFIAA<br>VERLWDYGMSSSPHVLRNRAQSGSVPQFKKVVFQEFTDGSFTQPLYRGELNEHLGLLGPYI<br>RAEVEDNIMVTFRNQASRPYSFYSSLISYEEDQRQGAEPRKNFVKPNETKTYFWKVQHHM<br>APTKDEFDCKAWAYFSDVDLEKDVHSGLIGPLLVCHTNTLNPAHGRQVTVQEFALFFTIFD<br>ETKSWYFTENMERNCRAPCNIQMEDPTFKENYRFHAINGYIMDTLPGLVMAQDQRIRWYL<br>LSMGSNENIHSIHFSGHVFTVRKKEEYKMALYNLYPGVFETVEMLPSKAGIWRVECLIGEH<br>LHAGMSTLFLVYSNKCQTPLGMASGHIRDFQITASGQYGQWAPKLARLHYSGSINAWSTK<br>EPFSWIKVDLLAPMIIHGIKTQGARQKFSSLYISQFIIMYSLDGKKWQTYRGNSTGTLMVFF<br>GNVDSSGIKHNIFNPPIIARYIRLHPTHYSIRSTLRMELMGCDLNSCSMPLGMESKAISDAQIT<br>ASSYFTNMFATWTPSKARLHLQGRSNAWRPQVNNPKEWLQVDFQKTMKVTGVTTQGVK<br>SLLTSMYVKEFLISSSQDGHQWTLFFQNGKVKVFQGNQDSFTPVVNSLDPPLLTRYLRIHPQ<br>SWVHQIALRMEVLGCEAQDLY |
| FVIII (A1-D345-AE144-Y346-D403-AE144-R405-R1797-AE288-Q1798-Y2322) | ATRRYYLGAVELSWDYMQSDLGELPVDARFPPRVPKSFPFNTSVVYKKTLFVEFTDHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMGTTPEVHSIFLEGHTFLVRNHRQASLEISPITFLTAQTLLMD<br>LGQPLLFCHISSHQHDGMEAYVKVDSCPEEPQLRMKNNEEAEDGGSEPATSGSETPGTSES<br>ATPESGPGSEPATSGSETPGSPAGSPTSTEEGTSTEPSEGSAPGSEPATSGSETPGSEPATSGSE<br>TPGSEPATSGSETPGTSTEPSEGSAPGTSESATPESGPGSEPATSGSETPGTSTEPSEGSAPGYD<br>DDLTDSEMDVVRFDDDNSPSFIQIRSVAKKHPKTWVHYIAAEEEDWDYAPLVLAPDDGGT<br>STPESGSASPGTSPSGESSTAPGTSPSGESSTAPGSTSSTAESPGPGSTSESPSGTAPGSTSSTAE<br>SPGPGTSPSGESSTAPGTSTPESGSASPGSTSSTAESPGPGTSPSGESSTAPGTSPSGESSTAPG<br>TSPSGESSTAPGRSYKSQYLNNGPQRIGRKYKKVRFMAYTDETFKTREAIQHESGILPLLY<br>GEVGDTLLIIFKNQASRPYNIYPHGITDVRPLYSRRLPKGVKHLKDFPILPGEIFKYKWTVTV<br>EDGPTKSDPRCLTRYYSSFVNMERDLASGLIGPLLICYKESVDQRGNQIMSDKRNVILFSVF<br>DENRSWYLTENIQRFLPNPAGVQLEDPEFQASNIMHSINGYVFDSLQLSVCLHEVAYWYILS<br>IGAQTDFLSVFFSGYTFKHKMVYEDTLTLFPFSGETVFMSMENPGLWILGCHNSDFRNRGM<br>TALLKVSSCDKNTGDYYEDSYEDISAYLLSKNNAIEPRSFSQNSRHPSTRQKQFNATTIPEN<br>DIEKTDPWFAHRTPMPKIQNVSSSDLLMLLRQSPTPHGLSLSDLQEAKYETFSDDPSPGAIDS<br>NNSLSEMTHFRPQLHHSGDMVFTPESGLQLRLNNEKLGTTAATELKKLDFKVSSTSNNLISTI<br>PSDNLAAGTDNTSSLGPPSMPVHYDSQLDTTLFGKKSSPLTESGGPLSLSEENNDSKLLESG<br>LMNSQESSWGKNVSSTESGRLFKGKRAHGPALLTKDNALFKVSISLLKTNKTSNNSATNRK<br>THIDGPSLLIENSPSVWQNILESDTEFKKVTPLIHDRMLMDKNATALRLNHMSNKTTSSKN<br>MEMVQQKKEGPIPPDAQNPDMSFFKMLFLPESARWIQRTHGKNSLNSGQGPSPKQLVSLGP<br>EKSVEGQNFLSEKNKVVVGKGEFTKDVGLKEMVFPSSRNLFLTNLDNLHENNTHNQEKKI<br>QEEIEKKETLIQENVVLPQIHTVTGTKNFMKNLFLLSTRQNVEGSYDGAYAPVLQDFRSLN<br>DSTNRTKKHTAHFSKKGEEENLEGLGNQTKQIVEKYACTTRISPNTSQQNFVTQRSKRALK<br>QFRLPLEETELEKRIIVDDTSTQWSKNMKHLTPSTLTQIDYNEKEKGAITQSPLSDCLTRSHSI<br>PQANRSPLPIAKVSSFPSIRPIYLTRVLFQDNSSHLPAASYRKKDSGVQESSHFLQGAKKNNL<br>SLAILTLEMTGDQREVGSLGTSATNSVTYKKVENTVLPKPDLPKTSGKVELLPKVHIYQKD<br>LFPTETESNGSPGHLDLVEGSLLQGTEGAIKWNEANRPGKVPFLRVATESSAKTPSKLLDPLA<br>WDNHYGTQIPKEEWKSQEKSPEKTAFKKKDTILSLNACESNHAIAAINEGQNKPEIEVTWA<br>KQGRTERLCSQNPPVLKRHQREITRTTLQSDQEEIDYDDTISVEMKKEDFDIYDEDENQSPR<br>SFQKKTRHYFIAAVERLWDYGMSSSPHVLRNRAQSGSVPQFKKVVFQEFTDGSFTQPLYRG<br>ELNEHLGLLGPYIRAEVEDNIMVTFRNQASRPYSFYSSLISYEEDQRGGTSESATPESGPGSE<br>PATSGSETPGTSESATPESGPGSEPATSGSETPGTSESATPESGPGSEPATSGSETPGSPAGSPT<br>STEEGTSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPGSEPAT<br>SGSETPGSPAGSPTSTEEGTSTEPSEGSAPGTSTEPSEGSAPGSEPATSGSETPGTSESATPESG<br>PGTSTEPSEGSAPGQGAEPRKNFVKPNETKTYFWKVQHHMAPTKDEFDCKAWAYFSDVDL<br>EKDVHSGLIGPLLVCHTNTLNPAHGRQVTVQEFALFFTIFDETKSWYFTENMERNCRAPCNI<br>QMEDPTFKENYRFHAINGYIMDTLPGLVMAQDQRIRWYLLSMGSNENIHSIHFSGHVFTVR<br>KKEEYKMALYNLYPGVFETVEMLPSKAGIWRVECLIGEHLHAGMSTLFLVYSNKCQTPLG<br>MASGHIRDFQITASGQYGQWAPKLARLHYSGSINAWSTKEPFSWIKVDLLAPMIIHGIKTQG<br>ARQKFSSLYISQFIIMYSLDGKKWQTYRGNSTGTLMVFFGNVDSSGIKHNIFNPPIIARYIRL<br>HPTHYSIRSTLRMELMGCDLNSCSMPLGMESKAISDAQITASSYFTNMFATWSPSKARLHL<br>QGRSNAWRPQVNNPKEWLQVDFQKTMKVTGVTTQGVKSLLTSMYVKEFLISSSQDGHQW<br>TLFFQNGKVKVFQGNQDSFTPVVNSLDPPLLTRYLRIHPQSWVHQIALRMEVLGCEAQDLY |
| FVIII (A1-N745)-AE864-(P1640-Y2332) | ATRRYYLGAVELSWDYMQSDLGELPVDARFPPRVPKSFPFNTSVVYKKTLFVEFTVHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMGTTPEVHSIFLEGHTFLVRNHRQASLEISPITFLTAQTLLMD<br>LGQPLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKY<br>KKVRFMAYTDETFKTREAIQHESGILPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSQNGGSPAGSPTSTEEGTSESATPESGPGTSTEPSEGSAPGSPAGSPTSTEEGT |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | STEPSEGSAPGTSTEPSEGSAPGTSESATPESGPGSEPATSGSETPGSEPATSGSETPGSPAGSP<br>TSTEEGTSESATPESGPGTSTEPSEGSAPGTSTEPSEGSAPGSPAGSPTSTEEGTSTEPSEGSAP<br>GTSTEPSEGSAPGTSESATPESGPGTSTEPSEGSAPGTSESATPESGPGSEPATSGSETPGTSTE<br>PSEGSAPGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGSAPGTS<br>TEPSEGSAPGTSTEPSEGSAPGTSTEPSEGSAPGSPAGSPTSTEEGTSTEPSEGSAPGTSESAPT<br>ESGPGSEPATSGSETPGTSESATPESGPGSEPATSGSETPGTSESATPESGPGTSTEPSEGSAPG<br>TSESATPESGPGSPAGSPTSTEEGSPAGSPTSTEEGSPAGSPTSTEEGTSESATPESGPGTSTEP<br>SEGSAPGTSESATPESGPGSEPATSGSETPGTSESATPESGPGSEPATSGSETPGTSESATPESG<br>PGTSTEPSEGSAPGSPAGSPTSTEEGTSESATPESGPGSEPATSGSETPGTSESATPESGPGSPA<br>GSPTSTEEGSPAGSPTSTEEGTSTEPSEGSAPGTSESATPESGPGTSESATPESGPGTSESAPTE<br>SGPGSEPATSGSETPGSEPATSGSETPGSPAGSPTSTEEGTSTEPSEGSAPGTSTEPSEGSAPGS<br>EPATSGSETPGTSESATPESGPGTSTEPSEGSAPGPPVLKRHQREITRTTLQSDQEEIDYDDTIS<br>VEMKKEDFDIYDEDENQSPRSFQKKTRHYFIAAVERLWDYGMSSSPHVLRNRAQSGSVPQ<br>FKKVVFQEFTDGSFTQPLYRGELNEHLGLLGPYIRAEVEDNIMVTFRNQASRPYSFYSSLISY<br>EEDQRQGAEPRKNFVKPNETKTYFWKVQHHMAPTKDEFDCKAWAYFSDVDLEKDVHSG<br>LIGPLLVCHTNTLNPAHGRQVTVQEFALFFTIFDETKSWYFTENMERNCRAPCNIQMEDPTF<br>KENYRFHAINGYIMDTLPGLVMAQDQRIRWYLLSMGSNENIHSIHFSGHVFTVRKKEEYK<br>MALYNLYPGVFETVEMLPSKAGIWRVECLIGEHLHAGMSTLFLVYSNKCQTPLGMASGHI<br>RDFQITASGQYGQWAPKLARLHYSGSINAWSTKEPFSWIKVDLLAPMIIHGIKTQGARQKFS<br>SLYISQFIIMYSLDGKKWQTYRGNSTGTLMVFFGNVDSSGIKHNIFNPPIIARYIRLHPTHYSI<br>RSTLRMELMGCDLNSCSMPLGMESKAISDAQITASSYFTNMFATWSPSKARLHLQGRSNA<br>WRPQVNNPKEWLQVDFQKTMKVTGVTTQGVKSLLTSMYVKEFLISSSQDGHQWTLFFQN<br>GKVKVFQGNQDSFTPVVNSLDPPLLTRYLRIHPQSWVHQIALRMEVLGCEAQDLY |
| FVIII BDD9<br>(A1-N745)-<br>AE288-<br>(P1640-<br>Y2332) | ATRRYYLGAVELSWDYMQSDLGELPVDARFPPRVPKSFPFNTSVVYKKTLFVEFTVHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMTTPEVHSIFLEGHTFLVRNHRQASLEISPITFLTAQTLLMD<br>LGQFLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSVKSQYLNNGPQRIGRKY<br>KKVRFMAYTDETFKTREAIQHESGILGPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSQNGGTSESATPESGPGSEPATSGSETPGTSESATPESGPGSEPATSGSETPGT<br>SESATPESGPGTSTEPSEGSAPGSPAGSPTSTEEGTSESATPESGPGSEPATSGSETPGTSESAT<br>PESGPGSPAGSPTSTEEGSPAGSPTSTEEGTSTEPSEGSAPGSESATPESGPGTSESATPESGP<br>GTSESATPESGPGSEPATSGSETPGSEPATSGSETPGSPAGSPTSTEEGTSTEPSEGSAPGTSTE<br>PSEGSAPGSEPATSGSETPGTSESATPESGPGTSTEPSEGSAPGPPVLKRHQREITRTTLQSDQ<br>EEIDYDDTISVEMKKEDFDIYDEDENQSPRSFQKKTRHYFIAAVERLWDYGMSSSPHVLRN<br>RAQSGSVPQFKKVVFQEFTDGSFTQPLYRGELNEHLGLLGPYIRAEVEDNIMVTFRNQASRP<br>YSFYSSLISYEEDQRQGAEPRKNFVKPNETKTYFWKVQHHMAPTKDEFDCKAWAYFSDVD<br>LEKDVHSGLIGPLLVCHTNTLNPAHGRQVTVQEFALFFTIFDETKSWYFTENMERNCRAPC<br>NIQMEDPTFKENYRFHAINGYIMDTLPGLVMAQDQRIRWYLLSMGSNENIHSIHFSGHVFT<br>VRKKEEYKMALYNLYPGVFETVEMLPSKAGIWRVECLIGEHLHAGMSTLFLVYSNKCQTP<br>LGMASGHIRDFQITASGQYGQWAPKLARLHYSGSINAWSTKEPFSWIKVDLLAPMIIHGIKT<br>QGARQKFSSLYISQFIIMYSLDGKKWQTYRGNSTGTLMVFFGNVDSSGIKHNIFNPPIIARYI<br>RLHPTHYSIRSTLRMELMGCDLNSCSMPLGMESKAISDAQITASSYFTNMFATWSPSKARL<br>HLQGRSNAWRPQVNNPKEWLQVDFQKTMKVTGVTTQGVKSLLTSMYVKEFLISSSQDGH<br>QWTLFFQNGKVKVFQGNQDSFTPVVNSLDPPLLTRYLRIHPQSWVHQIALRMEVLGCEAQ<br>DLY |
| FVIII BDD9<br>(A1-S743)-<br>AE288-<br>(Q1638-<br>Y2332) | ATRRYYLGAVELSWDYMQSDLGELPVDARFPPRVPKSFPFNTSVVYKKTLFVEFTVHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMTTPEVHSIFLEGHTFLVRNHRQASLEISPITFLTAQTLLMD<br>LGQFLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKY<br>KKVRFMAYTDETFKTREAIQHESGILGPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSGGTSESATPESGPGSEPATSGSETPGTSESATPESGPGSEPATSGSETPGTSES<br>ATPESGPGTSTEPSEGSAPGSPAGSPTSTEEGSPAGSPTSTEEGTSTEPSEGSAPGTSESATPESGPGTS<br>GPGSPAGSPTSTEEGSPAGSPTSTEEGTSTEPSEGSAPGTSESATPESGPGTSESATPESGPGTS<br>ESATPESGPGSEPATSGSETPGSEPATSGSETPGSPAGSPTSTEEGTSTEPSEGSAPGTSTEPSE<br>GSAPGSEPATSGSETPGTSESATPESGPGTSTEPSEGSAPGQNPPVLKRHQREITRTTLQSDQE<br>EIDYDDTISVEMKKEDFDIYDEDENQSPRSFQKKTRHYFIAAVERLWDYGMSSSPHVLRNR<br>AQSGSVPQFKKVVFQEFTDGSFTQPLYRGELNEHLGLLGPYIRAEVEDNIMVTFRNQASRP |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | YSFYSSLISYEEDQRQGAEPRKNFVKPNETKTYFWKVQHHMAPTKDEFDCKAWAYFSDVD<br>LEKDVHSGLIGPLLVCHTNTLNPAHGRQVTVQEFALFFTIFDETKSWYFTENMERNCRAPC<br>NIQMEDPTFKENYRFHAINGYIMDTLPGLVMAQDQRIRWYLLSMGSNENIHSIHFSGHVFT<br>VRKKEEYKMALYNLYPGVFETVEMLPSKAGIWRVECLIGEHLHAGMSTLFLVYSNKCQTP<br>LGMASGHIRDFQITASGQYGQWAPKLARLHYSGSINAWSTKEPFSWIKVDLLAPMIIHGIKT<br>QGARQKFSSLYISQFIIMYSLDGKKWQTYRGNSTGTLMVFFGNVDSSGIKHNIFNPPIIARYI<br>RLHPTHYSIRSTLRMELMGCDLNSCSMPLGMESKAISDAQITASSYFTNMFATWSPSKARL<br>HLQGRSNAWRPQVNNPKEWLQVDFQKTMKVTGVTTQGVKSLLTSMYVKEFLISSSQDGH<br>QWTLFFQNGKVKVFQGNQDSFTPVVNSLDPPLLTRYLRIHPQSWVHQIALRMEVLGCEAQ<br>DLY |
| FVIII BDD9<br>(A1-N745)-<br>AG288_2-<br>(P1640-<br>Y2332)-<br>AG288_2 | ATRRYYLGAVELSWDYMQSDLGELPVDARFPPRVPKSFPFNTSVVYKKTLFVEFTVHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMGTTPEVHSIFLEGHTFLVRNHRQASLEISPITFLTAQTLLMD<br>LGQPLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKY<br>KKVRFMAYTDETFKTREAIQHESGILGPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSQNGPGASPGTSSTGSPGASPGTSSTGSPGTPGSGTASSSPGSSTPSGATGSPG<br>TPGSGTASSSPGSSTPSGATGSPGTPGSGTASSSPGSSTPSGATGSPGSSTPSGATGSPGSSPSA<br>STGTGPGSSPSASTGTGPGASPGTSSTGSPGTPGSGTASSSPGSSTPSGATGSPGSSPSASTGT<br>GPGSSPSASTGTGPGASPGTSSTGSPGASPGTSSTGSPGSSTPSGATGSPGSSPSASTGTGPGA<br>SPGTSSTGSPGSSPSASTGTGPGTPGSGTASSSPGSSTPSGATGSGPPVLKRHQREITRTTLQS<br>DQEEIDYDDTISVEMKKEDFDIYDEDENQSPRSFQKKTRHYFIAAVERLWDYGMSSSPHVL<br>RNRAQSGSVPQFKKVVFQEFTDGSFTQPLYRGELNEHLGLLGPYIRAEVEDNIMVTFRNQA<br>SRPYSFYSSLISYEEDQRQGAEPRKNFVKPNETKTYFWKVQHHMAPTKDEFDCKAWAYFS<br>DVDLEKDVHSGLIGPLLVCHTNTLNPAHGRQVTVQEFALFFTIFDETKSWYFTENMERNCR<br>APCNIQMEDPTFKENYRFHAINGYIMDTLPGLVMAQDQRIRWYLLSMGSNENIHSIHFSGH<br>VFTVRKKEEYKMALYNLYPGVFETVEMLPSKAGIWRVECLIGEHLHAGMSTLFLVYSNKC<br>QTPLGMASGHIRDFQITASGQYGQWAPKLARLHYSGSINAWSTKEPFSWIKVDLLAPMBH<br>GIKTQGARQKFSSLYISQFIIMYSLDGKKWQTYRGNSTGTLMVFFGNVDSSGIKHNIFNPPII<br>ARYIRLHPTHYSIRSTLRMELMGCDLNSCSMPLGMESKAISDAQITASSYFTNMFATWSPSK<br>ARLHLQGRSNAWRPQVNNPKEWLQVDFQKTMKVTGVTTQGVKSLLTSMYVKEFLISSSQ<br>DGHQWTLFFQNGKVKVFQGNQDSFTPVVNSLDPPLLTRYLRIHPQSWVHQIALRMEVLGC<br>EAQDLYGAGSPGAETAPGASPGTSSTGSPGASPGTSSTGSPGTPGSGTASSSPGSSTPSGATG<br>SPGTPGSGTASSSPGSSTPSGATGSPGTPGSGTASSSPGSSTPSGATGSPGSSTPSGATGSPGSS<br>PSASTGTGPGSSPSASTGTGPGASPGTSSTGSPGTPGSGTASSSPGSSTPSGATGSPGSSPSAST<br>GTGPGSSPSASTGTGPGASPGTSSTGSPGASPGTSSTGSPGSSTPSGATGSPGSSPSASTGTGP<br>GASPGTSSTGSPGSSPSASTGTGPGTPGSGTASSSPGSSTPSGATGSGAETAEQKLISEEDLSP<br>ATG |
| FVIII BDD9<br>(A1-S743)-<br>AG288_2-<br>(Q1638-<br>Y2332)-<br>AG288_2 | ATRRYYLGAVELSWDYMQSDLGELPVDARFPPRVPKSFPFNTSVVYKKTLFVEFTVHLFNI<br>AKPRPPWMGLLGPTIQAEVYDTVVITLKNMASHPVSLHAVGVSYWKASEGAEYDDQTSQ<br>REKEDDKVFPGGSHTYVWQVLKENGPMASDPLCLTYSYLSHVDLVKDLNSGLIGALLVCR<br>EGSLAKEKTQTLHKFILLFAVFDEGKSWHSETKNSLMQDRDAASARAWPKMHTVNGYVN<br>RSLPGLIGCHRKSVYWHVIGMGTTPEVHSIFLEGHTFLVRNHRQASLEISPITFLTAQTLLMD<br>LGQPLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKY<br>KKVRFMAYTDETFKTREAIQHESGILGPLLYGEVGDTLLIIFKNQASRPYNIYPHGITDVRPL<br>YSRRLPKGVKHLKDFPILPGEIFKYKWTVTVEDGPTKSDPRCLTRYYSSFVNMERDLASGLI<br>GPLLICYKESVDQRGNQIMSDKRNVILFSVFDENRSWYLTENIQRFLPNPAGVQLEDPEFQA<br>SNIMHSINGYVFDSLQLSVCLHEVAYWYILSIGAQTDFLSVFFSGYTFKHKMVYEDTLTLFP<br>FSGETVFMSMENPGLWILGCHNSDFRNRGMTALLKVSSCDKNTGDYYEDSYEDISAYLLS<br>KNNAIEPRSFSGPGASPGTSSTGSPGASPGTSSTGSPGTPGSGTASSSPGSSTPSGATGSPGTP<br>GSGTASSSPGSSTPSGATGSPGTPGSGTASSSPGSSTPSGATGSPGSSTPSGATGSPGSSPSAST<br>GTGPGSSPSASTGTGPGASPGTSSTGSPGTPGSGTASSSPGSSTPSGATGSPGSSPSASTGTGP<br>GSSPSASTGTGPGASPGTSSTGSPGASPGTSSTGSPGSSTPSGATGSPGSSPSASTGTGPGASP<br>GTSSTGSPGSSPSASTGTGPGTPGSGTASSSPGSSTPSGATGSGQNPPVLKRHQREITRTTLQS<br>DQEEIDYDDTISVEMKKEDFDIYDEDENQSPRSFQKKTRHYFIAAVERLWDYGMSSSPHVL<br>RNRAQSGSVPQFKKVVFQEFTDGSFTQPLYRGELNEHLGLLGPYIRAEVEDNIMVTFRNQA<br>SRPYSFYSSLISYEEDQRQGAEPRKNFVKPNETKTYFWKVQHHMAPTKDEFDCKAWAYFS<br>DVDLEKDVHSGLIGPLLVCHTNTLNPAHGRQVTVQEFALFFTIFDETKSWYFTENMERNCR<br>APCNIQMEDPTFKENYRFHAINGYIMDTLPGLVMAQDQRIRWYLLSMGSNENIHSIHFSGH<br>VFTVRKKEEYKMALYNLYPGVFETVEMLPSKAGIWRVECLIGEHLHAGMSTLFLVYSNKC<br>QTPLGMASGHIRDFQITASGQYGQWAPKLARLHYSGSINAWSTKEPFSWIKVDLLAPMBH<br>GIKTQGARQKFSSLYISQFIIMYSLDGKKWQTYRGNSTGTLMVFFGNVDSSGIKHNIFNPPII<br>ARYIRLHPTHYSIRSTLRMELMGCDLNSCSMPLGMESKAISDAQITASSYFTNMFATWSPSK<br>ARLHLQGRSNAWRPQVNNPKEWLQVDFQKTMKVTGVTTQGVKSLLTSMYVKEFLISSSQ<br>DGHQWTLFFQNGKVKVFQGNQDSFTPVVNSLDPPLLTRYLRIHPQSWVHQIALRMEVLGC |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| | EAQDLYGAGSPGAETAPGASPGTSSTGSPGASPGTSSTGSPGTPGSGTASSSPGSSTPSGATG SPGTPGSGTASSSPGSSTPSGATGSPGTPGSGTASSSPGSSTPSGATGSPGSSTPSGATGSPGSS PSASTGTGPGSSPSASTGTGPGASPGTSSTGSPGTPGSGTASSSPGSSTPSGATGSPGSSPSAST GTGPGSSPSASTGTGPGASPGTSSTGSPGASPGTSSTGSPGSSTPSGATGSPGSSPSASTGTGP GASPGTSSTGSPGSSPSASTGTGPGTPGSGTASSSPGSSTPSGATGSGAETAEQKLISEEDLSP ATG |
| FVIII BDD10 (A1-N745)- AE288- (P1640- Y2332)- AE288 | ATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQ REKEDDKVFPGGSHTYVWQVLKENGPMASDPLCLTYSYLSHVDLVKDLNSGLIGALLVCR EGSLAKEKTQTLHKFILLFAVFDEGKSWHSETKNSLMQDRDAASARAWPKMHTVNGYVN RSLPGLIGCHRKSVYWHVIGMTTPEVHSIFLEGHTFLVRNHRQASLEISPITFLTAQTLLMD LGQFLLFCHISSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNNGPQRIGRKY KKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLI GPLLICYKESVDQRGNQIMSDKRNVILFSVFDENRSWYLTENIQRFLPNPAGVQLEDPEFQA SNIMHSINGYVFDSLQLSVCLHEVAYWYILSIGAQTDFLSVFFSGYTFKHKMVYEDTLTLFP FSGETVFMSMENPGLWILGCHNSDFRNRGMTALLKVSSCDKNTGDYYEDSYEDISAYLLS KNNAIEPRSFSQNGGTSESATPESGPGSEPATSGSETPGTSESATPESGPGSEPATSGSETPGT SESATPESGPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGSAPGTSTE PSEGSAPGSEPATSGSETPGTSESATPESGPGTSTEPSEGSAPGPPVLKRHQAEITRTTLQSDQ EEIDYDDTISVEMKKEDFDIYDEDENQSPRSFQKKTRHYFIAAVERLWDYGMSSSPHVLRN RAQSGSVPQFKKVVFQEFTDGSFTQPLYRGELNEHLGLLGPYIRAEVEDNIMVTFRNQASRP YSFYSSLISYEEDQRQGAEPRKNFVKPNETKTYFWKVQHHMAPTKDEFDCKAWAYFSDVD LEKDVHSGLIGPLLVCHTNTLNPAHGRQVTVQEFALFFTIFDETKSWYFTENMERNCRAPC NIQMEDPTFKENYRFHAINGYIMDTLPGLVMAQDQRIRWYLLSMGSNENIHSIHFSGHVFT VRKKEEYKMALYNLYPGVFETVEMLPSKAGIWRVECLIGEHLHAGMSTLFLVYSNKCQTP LGMASGHIRDFQITASGQYGQWAPKLARLHYSGSINAWSTKEPFSWIKVDLLAPMIIHGIKT QGARQKFSSLYISQFIIMYSLDGKKWQTYRGNSTGTLMVFFGNVDSSGIKHNIFNPPIIARYI RLHPTHYSIRSTLRMELMGCDLNSCSMPLGMESKAISDAQITASSYFTNMFATWSPSKARL HLQGRSNAWRPQVNNPKEWLQVDFQKTMKVTGVTTQGVKSLLTSMYVKEFLISSSQDGH QWTLFFQNGKVKVFQGNQDSFTPVVNSLDPPLLTRYLRIHPQSWVHQIALRMEVLGCEAQ DLYGGTSESATPESGPGSEPATSGSETPGTSESATPESGPGSEPATSGSETPGTSESATPESGP GTSTEPSEGSAPGSPAGSPTSTEEGSPAGSPTSTEEGTSTEPSEGSAPGTSESATPESGPGSPAG SPTSTEEGSPAGSPTSTEEGTSTEPSEGSAPGTSESATPESGPGTSESATPES GPGSEPATSGSETPGSEPATSGSETPGSPAGSPTSTEEGTSTEPSEGSAPGTSTEPSEGSAPGSE PATSGSETPGTSESATPESGPGTSTEPSEGSAP |
| FVIII BDD10 (A1-S743)- AE288- (Q1638- Y2332)- AE288 | ATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQ REKEDDKVFPGGSHTYVWQVLKENGPMASDPLCLTYSYLSHVDLVKDLNSGLIGALLVCR EGSLAKEKTQTLHKFILLFAVFDEGKSWHSETKNSLMQDRDAASARAWPKMHTVNGYVN RSLPGLIGCHRKSVYWHVIGMTTPEVHSIFLEGHTFLVRNHRQASLEISPITFLTAQTLLMD LGQFLLFCHISSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNNGPQRIGRKY KKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLI GPLLICYKESVDQRGNQIMSDKRNVILFSVFDENRSWYLTENIQRFLPNPAGVQLEDPEFQA SNIMHSINGYVFDSLQLSVCLHEVAYWYILSIGAQTDFLSVFFSGYTFKHKMVYEDTLTLFP FSGETVFMSMENPGLWILGCHNSDFRNRGMTALLKVSSCDKNTGDYYEDSYEDISAYLLS KNNAIEPRSFSGGTSESATPESGPGSEPATSGSETPGTSESATPESGPGSEPATSGSETPGTSES ATPESGPGTSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSTEPSE GSAPGSEPATSGSETPGTSESATPESGPGTSTEPSEGSAPGQNPPVLKRHQAEITRTTLQSDQE EIDYDDTISVEMKKEDFDIYDEDENQSPRSFQKKTRHYFIAAVERLWDYGMSSSPHVLRNR AQSGSVPQFKKVVFQEFTDGSFTQPLYRGELNEHLGLLGPYIRAEVEDNIMVTFRNQASRP YSFYSSLISYEEDQRQGAEPRKNFVKPNETKTYFWKVQHHMAPTKDEFDCKAWAYFSDVD LEKDVHSGLIGPLLVCHTNTLNPAHGRQVTVQEFALFFTIFDETKSWYFTENMERNCRAPC NIQMEDPTFKENYRFHAINGYIMDTLPGLVMAQDQRIRWYLLSMGSNENIHSIHFSGHVFT VRKKEEYKMALYNLYPGVFETVEMLPSKAGIWRVECLIGEHLHAGMSTLFLVYSNKCQTP LGMASGHIRDFQITASGQYGQWAPKLARLHYSGSINAWSTKEPFSWIKVDLLAPMIIHGIKT QGARQKFSSLYISQFIIMYSLDGKKWQTYRGNSTGTLMVFFGNVDSSGIKHNIFNPPIIARYI RLHPTHYSIRSTLRMELMGCDLNSCSMPLGMESKAISDAQITASSYFTNMFATWSPSKARL HLQGRSNAWRPQVNNPKEWLQVDFQKTMKVTGVTTQGVKSLLTSMYVKEFLISSSQDGH QWTLFFQNGKVKVFQGNQDSFTPVVNSLDPPLLTRYLRIHPQSWVHQIALRMEVLGCEAQ DLYGGTSESATPESGPGSEPATSGSETPGTSESATPESGPGSEPATSGSETPGTSESATPESGP GTSTEPSEGSAPGSPAGSPTSTEEGSESATPESGPGSEPATSGSETPGTSESATPESGPGSPAG SPTSTEEGSPAGSPTSTEEGTSTEPSEGSAPGTSESATPESGPGTSESATPES GPGSEPATSGSETPGSEPATSGSETPGSPAGSPTSTEEGTSTEPSEGSAPGTSTEPSEGSAPGSE PATSGSETPGTSESATPESGPGTSTEPSEGSAP |

TABLE 50-continued

Exemplary CFXTEN comprising FVIII and internal/external XTEN sequences (SEQ ID NOS 1537-1554, respectively, in order of appearance)

| CFXTEN Name | Amino AcidSequence |
|---|---|
| FVIII BDD10 (A1-N745)- AG288_2- (P1640- Y2332)- AG288_2 | ATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQ REKEDDKVFPGGSHTYVWQVLKENGPMASDPLCLTYSYLSHVDLVKDLNSGLIGALLVCR EGSLAKEKTQTLHKFILLFAVFDEGKSWHSETKNSLMQDRDAASARAWPKMHTVNGYVN RSLPGLIGCHRKSVYWHVIGMTTPEVHSIFLEGHTFLVRNHRQASLEISPITFLTAQTLLMD LGQFLLFCHISSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNNGPQRIGRKY KKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLI GPLLICYKESVDQRGNQIMSDKRNVILFSVFDENRSWYLTENIQRFLPNPAGVQLEDPEFQA SNIMHSINGYVFDSLQLSVCLHEVAYWYILSIGAQTDFLSVFFSGYTFKHKMVYEDTLTLFP FSGETVFMSMENPGLWILGCHNSDFRNRGMTALLKVSSCDKNTGDYYEDSYEDISAYLLS KNNAIEPRSFSQNGPGASPGTSSTGSPGASPGTSSTGSPGTPGSGTASSSPGSSTPSGATGSPG TPGSGTASSSPGSSTPSGATGSPGTPGSGTASSSPGSSTPSGATGSPGSSTPSGATGSPGSSPSA STGTGPGSSPSASTGTGPGASPGTSSTGSPGTPGSGTASSSPGSSTPSGATGSPGSSPSASTGT GPGSSPSASTGTGPGASPGTSSTGSPGASPGTSSTGSPGSSTPSGATGSPGSSPSASTGTGPGA SPGTSSTGSPGSSPSASTGTGPTPGSGTASSSPGSSTPSGATGSPPVLKRHQAEITRTTLQSD QEEIDYDDTISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIMVTFRNQAS RPYSFYSSLISYEEDQRQGAEPRKNFVKPNETKTYFWKVQHHMAPTKDEFDCKAWAYFSD VDLEKDVHSGLIGPLLVCHTNTLNPAHGRQVTVQEFALFFTIFDETKSWYFTENMERNCRA PCNIQMEDPTFKENYRFHAINGYIMDTLPGLVMAQDQRIRWYLLSMGSNENIHSIHFSGHVF TVRKKEEYKMALYNLYPGVFETVEMLPSKAGIWRVECLIGEHLHAGMSTLFLVYSNKCQT PLGMASGHIRDFQITASGQYGQWAPKLARLHYSGSINAWSTKEPFSWIKVDLLAPMBHGIK TQGARQKFSSLYISQFIIMYSLDGKKWQTYRGNSTGTLMVFFGNVDSSGIKHNIFNPPIIARY IRLHPTHYSIRSTLRMELMGCDLNSCSMPLGMESKAISDAQITASSYFTNMFATWSPSKARL HLQGRSNAWRPQVNNPKEWLQVDFQKTMKVTGVTTQGVKSLLTSMYVKEFLISSSQDGH QWTLFFQNGKVKVFQGNQDSFTPVVNSLDPPLLTRYLRIHPQSWVHQIALRMEVLGCEAQ DLYGAGSPGAETAPGASPGTSSTGSPGASPGTSSTGSPGTPGSGTASSSPGSSTPSGATGSPG TPGSGTASSSPGSSTPSGATGSPGTPGSGTASSSPGSSTPSGATGSPGSSTPSGATGSPGSSPSA STGTGPGSSPSASTGTGPGASPGTSSTGSPGTPGSGTASSSPGSSTPSGATGSPGSSPSASTGT GPGSSPSASTGTGPGASPGTSSTGSPGASPGTSSTGSPGSSTPSGATGSPGSSPSASTGTGPGA SPGTSSTGSPGSSPSASTGTGPGTPGSGTASSSPGSSTPSGATGSGAETAEQKLISEEDLSPAT G |
| FVIII BDD10 (A1-S743)- AG288_2- (Q1638- Y2332)- AG288_2 | ATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQ REKEDDKVFPGGSHTYVWQVLKENGPMASDPLCLTYSYLSHVDLVKDLNSGLIGALLVCR EGSLAKEKTQTLHKFILLFAVFDEGKSWHSETKNSLMQDRDAASARAWPKMHTVNGYVN RSLPGLIGCHRKSVYWHVIGMTTPEVHSIFLEGHTFLVRNHRQASLEISPITFLTAQTLLMD LGQFLLFCHISSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNNGPQRIGRKY KKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLI GPLLICYKESVDQRGNQIMSDKRNVILFSVFDENRSWYLTENIQRFLPNPAGVQLEDPEFQA SNIMHSINGYVFDSLQLSVCLHEVAYWYILSIGAQTDFLSVFFSGYTFKHKMVYEDTLTLFP FSGETVFMSMENPGLWILGCHNSDFRNRGMTALLKVSSCDKNTGDYYEDSYEDISAYLLS KNNAIEPRSFSGPGASPGTSSTGSPGASPGTSSTGSPGTPGSGTASSSPGSSTPSGATGSPGTP GSGTASSSPGSSTPSGATGSPGTPGSGTASSSPGSSTPSGATGSPGSSTPSGATGSPGSSPSAST GTGPGSSPSASTGTGPGASPGTSSTGSPGTPGSGTASSSPGSSTPSGATGSPGSSPSASTGTGP GSSPSASTGTGPGASPGTSSTGSPGASPGTSSTGSPGSSTPSGATGSPGSSPSASTGTGPGASP GTSSTGSPGSSPSASTGTGPGTPGSGTASSSPGSSTPSGATGSQNPPVLKRHQAEITRTTLQSD QEEIDYDDTISVEMKKEDFDIYDEDENQSPRSFQKKTRHYFIAAVERLWDYGMSSSPHVLR NRAQSGSVPQFKKVVFQEFTDGSFTQPLYRGELNEHLGLLGPYIRAEVEDNIMVTFRNQAS RPYSFYSSLISYEEDQRQGAEPRKNFVKPNETKTYFWKVQHHMAPTKDEFDCKAWAYFSD VDLEKDVHSGLIGPLLVCHTNTLNPAHGRQVTVQEFALFFTIFDETKSWYFTENMERNCRA PCNIQMEDPTFKENYRFHAINGYIMDTLPGLVMAQDQRIRWYLLSMGSNENIHSIHFSGHVF TVRKKEEYKMALYNLYPGVFETVEMLPSKAGIWRVECLIGEHLHAGMSTLFLVYSNKCQT PLGMASGHIRDFQITASGQYGQWAPKLARLHYSGSINAWSTKEPFSWIKVDLLAPMIIHGIK TQGARQKFSSLYISQFIIMYSLDGKKWQTYRGNSTGTLMVFFGNVDSSGIKHNIFNPPIIARY IRLHPTHYSIRSTLRMELMGCDLNSCSMPLGMESKAISDAQITASSYFTNMFATWSPSKARL HLQGRSNAWRPQVNNPKEWLQVDFQKTMKVTGVTTQGVKSLLTSMYVKEFLISSSQDGH QWTLFFQNGKVKVFQGNQDSFTPVVNSLDPPLLTRYLRIHPQSWVHQIALRMEVLGCEAQ DLYGAGSPGAETAPGASPGTSSTGSPGASPGTSSTGSPGTPGSGTASSSPGSSTPSGATGSPG TPGSGTASSSPGSSTPSGATGSPGTPGSGTASSSPGSSTPSGATGSPGSSTPSGATGSPGSSPSA STGTGPGSSPSASTGTGPGASPGTSSTGSPGTPGSGTASSSPGSSTPSGATGSPGSSPSASTGT GPGSSPSASTGTGPGASPGTSSTGSPGASPGTSSTGSPGSSTPSGATGSPGSSPSASTGTGPGA SPGTSSTGSPGSSPSASTGTGPGTPGSGTASSSPGSSTPSGATGSGAETAEQKLISEEDLSPAT G |

Sequence name reflects N- to C-terminus configuration of the FVIII segments (amino acid spanning numbers relative to mature sequence) and XTEN components

TABLE 51

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| SP-AE288-CS-L-(FVIII_1-745)-AE288-(FVIII_1686-2332)-L-CS-AE288 | MQIELSTCFFLCLLRFCFSGTSESATPESGPGSEPATSGSETPGTSESATPESGPGSEPATSGSETP GTSESATPESGPGTSTEPSEGSAPGSPAGSPTSTEEGTSESATPESGPGSEPATSGSETPGTSESA TPESGPGSPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGSAPGTSTEPS EGSAPGSEPATSGSETPGTSESATPESGPGTSTEPSEGSAPQSPRSFQGPEGPSATRRYYLGAVE LSWDYMQSDLGELPVDARFPPRVPKSFPFNTSVVYKKTLFVEFTVHLFNIAKPRPPWMGLLG PTIQAEVYDTVVITLKNMASHPVSLHAVGVSYWKASEGAEYDDQTSQREKEDDKVFPGGSH TYVWQVLKENGPMASDPLCLTYSYLSHVDLVKDLNSGLIGALLVCREGSLAKEKTQTLHKFI LLFAVFDEGKSWHSETKNSLMQDRDAASARAWPKMHTVNGYVNRSLPGLIGCHRKSVYWH VIGMGTTPEVHSIFLEGHTFLVRNHRQASLEISPITFLTAQTLLMDLGQFLLFCHISSHQHDGM EAYVKVDSCPEEPQLRMKNNEEAEDYDDDLTDSEMDVVRFDDDNSPSFIQIRSVAKKHPKT WVHYIAAEEEDWDYAPLVLAPDDRSYKSQYLNNGPQRIGRKYKKVRFMAYTDETFKTREAI QHESGILGPLLYGEVGDTLLIIFKNQASRPYNIYPHGITDVRPLYSRRLPKGVKHLKDFPILPGEI FKYKWTVTVEDGPTKSDPRCLTRYYSSFVNMERDLASGLIGPLLICYKESVDQRGNQIMSDK RNVILFSVFDENRSWYLTENIQRFLPNPAGVQLEDPEFQASNIMHSINGYVFDSLQLSVCLHEV AYWYILSIGAQTDFLSVFFSGYTFKHKMVYEDTLTLFPFSGETVFMSMENPGLWILGCHNSDF RNRGMTALLKVSSCDKNTGDYYEDSYEDISAYLLSKNNAIEPRSFSQNGTSESATPESGPGSEP ATSGSETPGTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPTSTEEGTSI EPSEGSAPGTSESATPESGPGTSESATPESGPGSESATPESGPGSEPATSGSETPGSEPATSGSE TPGSPAGSPTSTEEGTSTEPSEGSAPGTSTEPSEGSAPGSEPATSGSETPGTSESATPESGPGTST EPSEGSAPQSPRSFQKKTRHYFIAAVERLWDYGMSSSPHVLRNRAQSGSVPQFKKVVFQEFTD GSFTQPLYRGELNEHLGLLGPYIRAEVEDNIMVTFRNQASRPYSFYSSLISYEEDQRQGAEPRK NFVKPNETKTYFWKVQHHMAPTKDEFDCKAWAYFSDVDLEKDVHSGLIGPLLVCHTNTLNP AHGRQVTVQEFALFFTIFDETKSWYFTENMERNCRAPCNIQMEDPTFKENYRFHAINGYIMD TLPGLVMAQDQRIRWYLLSMGSNENIHSIHFSGHVFTVRKKEEYKMALYNLYPGVFETVEML PSKAGIWRVECLIGEHLHAGMSTLFLVYSNKCQTPLGMASGHIRDFQITASGQYGQWAPKLA RLHYSGSINAWSTKEPFSWIKVDLLAPMIIHGIKTQGARQKFSSLYISQFIIMYSLDGKKWQTY RGNSTGTLMVFFGNVDSSGIKHNIFNPPIIARYIRLHPTHYSIRSTLRMELMGCDLNSCSMPLG MESKAISDAQITASSYFTNMFATWSPSKARLHLQGRSNAWRPQVNNPKEWLQVDFQKTMKV TGVTTQGVKSLLTSMYVKEFLISSSQDGHQWTLFFQNGKVKVFQGNQDSFTPVVNSLDPPLL TRYLRIHPQSWVHQIALRMEVLGCEAQDLYGPEGPSQSPRSFQGTSESATPESGPGSEPATSGS ETPGTSESATPESGPGSEPATSGSETPGTSESATPESGPGTSTEPSEGSAPGSPAGSPTSTEEGTS ESATPESGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSETPGSPA GSPTSTEEGTSTEPSEGSAPGTSTEPSEGSAPGSEPATSGSETPGTSESATPESGPGTSTEPSEGS AP |
| SP-AE576-CS-L-(FVIII_1-745)-AE576-(FVIII_1686-2332)-L-CS-AE288 | MQIELSTCFFLCLLRFCFSGSPAGSPTSTEEGTSESATPESGPGTSTEPSEGSAPGSPAGSPTSTEE GTSTEPSEGSAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTSTEPSEGSAP GTSTEPSEGSAPGTSESATPESGPGTSTEPSEGSAPGTSESATPESGPGSEPATSGSETPGTSTEPS EGSAPGTSTEPSEGSAPGTSESATPESGPGTSESATPESGPGSPAGSPTSTEEGTSESATPESGPG SEPATSGSETPGTSESATPESGPGTSTEPSEGSAPGTSTEPSEGSAPGTSTEPSEGSAPGTSTEPSE GSAPGTSTEPSEGSAPGTSTEPSEGSAPGSPAGSPTSTEEGTSTEPSEGSAPGTSESATPESGPGS EPATSGSETPGTSESATPESGPGSEPATSGSETPGTSESATPESGPGTSTEPSEGSAPGTSESATP ESGPGSPAGSPTSTEEGSPAGSPTSTEEGSPAGSPTSTEEGTSESATPESGPGTSTEPSEGSAPQS PRSFQGPSGPATRRYYLGAVELSWDYMQSDLGELPVDARFPPRVPKSFPFNTSVVYKKTLFV EFTVHLFNIAKPRPPWMGLLGPTIQAEVYDTVVITLKNMASHPVSLHAVGVSYWKASEGAEY DDQTSQREKEDDKVFPGGSHTYVWQVLKENGPMASDPLCLTYSYLSHVDLVKDLNSGLIGA LLVCREGSLAKEKTQTLHKFILLFAVFDEGKSWHSETKNSLMQDRDAASARAWPKMHTVNG YVNRSLPGLIGCHRKSVYWHVIGMGTTPEVHSIFLEGHTFLVRNHRQASLEISPITFLTAQTLL MDLGQFLLFCHISSHQHDGMEAYVKVDSCPEEPQLRMKNNEEAEDYDDDLTDSEMDVVRFD DDNSPSFIQIRSVAKKHPKTWVHYIAAEEEDWDYAPLVLAPDDRSYKSQYLNNGPQRIGRKY KKVRFMAYTDETFKTREAIQHESGILGPLLYGEVGDTLLIIFKNQASRPYNIYPHGITDVRPLY SRRLPKGVKHLKDFPILPGEIFKYKWTVTVEDGPTKSDPRCLTRYYSSFVNMERDLASGLIGP LLICYKESVDQRGNQIMSDKRNVILFSVFDENRSWYLTENIQRFLPNPAGVQLEDPEFQASNI MHSINGYVFDSLQLSVCLHEVAYWYILSIGAQTDFLSVFFSGYTFKHKMVYEDTLTLFPFSGE TVFMSMENPGLWILGCHNSDFRNRGMTALLKVSSCDKNTGDYYEDSYEDISAYLLSKNNAIE PRSFSQNGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEEGTSES ATPESGPGTSTEPSEGSAPGTSTEPSEGSAPGSPAGSPTSTEEGTSTEPSEGSAPGTSTEPSEGSA PGTSESATPESGPGTSTEPSEGSAPGTSESATPESGPGSEPATSGSETPGTSTEPSEGSAPGTSTEP SEGSAPGTSESATPESGPGTSESATPESGPGSPAGSPTSTEEGTSESATPESGPGSEPATSGSETP GTSESATPESGPGTSTEPSEGSAPGTSTEPSEGSAPGTSTEPSEGSAPGTSTEPSEGSAPGTSTEP SEGSAPGTSTEPSEGSAPGSPAGSPTSTEEGTSTEPSEGSAPGTSESATPESGPGSEPATSGSETPG TSESATPESGPGSEPATSGSETPGTSESATPESGPGTSTEPSEGSAPGTSESATPESGPGSPAGSP TSTEEGSPAGSPTSTEEGSPAGSPTSTEEGTSESATPESGPGTSTEPSEGSAPQSPRSFQKKTRHY FIAAVERLWDYGMSSSPHVLRNRAQSGSVPQFKKVVFQEFTDGSFTQPLYRGELNEHLGLLG PYIRAEVEDNIMVTFRNQASRPYSFYSSLISYEEDQRQGAEPRKNFVKPNETKTYFWKVQHH MAPTKDEFDCKAWAYFSDVDLEKDVHSGLIGPLLVCHTNTLNPAHGRQVTVQEFALFFTIFD ETKSWYFTENMERNCRAPCNIQMEDPTFKENYRFHAINGYIMDTLPGLVMAQDQRIRWYLLS MGSNENIHSIHFSGHVFTVRKKEEYKMALYNLYPGVFETVEMLPSKAGIWRVECLIGEHLHA GMSTLFLVYSNKCQTPLGMASGHIRDFQITASGQYGQWAPKLARLHYSGSINAWSTKEPFSW |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | IKVDLLAPMIIHGIKTQGARQKFSSLYISQFIIMYSLDGKKWQTYRGNSTGTLMVFFGNVDSSG IKHNIFNPPIIARYIRLHPTHYSIRSTLRMELMGCDLNSCSMPLGMESKAISDAQITASSYFTNM FATWSPSKARLHLQGRSNAWRPQVNNPKEWLQVDFQKTMKVTGVTTQGVKSLLTSMYVKE FLISSSQDGHQWTLFFQNGKVKVFQGNQDSFTPVVNSLDPPLLTRYLRIHPQSWVHQIALRME VLGCEAQDLYGPEGPSQSPRSFQGTSESATPESGPGSEPATSGSETPGTSESATPESGPGSEPAT SGSETPGTSESATPESGPGTSTEPSEGSAPGSPAGSPTSTEEGTSESATPESGPGSEPATSGSETP GTSESATPESGPGSPAGSPTSTEEGSPAGSPTSTEEGTSEPSEGSAPGTSESATPESGPGTSESA TPESGPGTSESATPESGPGSEPATSGSETPGSEPATSGSETPGSPAGSPTSTEEGTSTEPSEGSAP GTSTEPSEGSAPGSEPATSGSETPGTSESATPESGPGTSTEPSEGSAP |
| SP-(FVIII_1-745)-AE576-(FVIII_1686-2332)-L-CS-AE576 | MQIELSTCFFLCLLRFCFSATRRYYLGAVELSWDYMQSDLGELPVDARFPPRVPKSFPFNTSV VYKKTLFVEFTVHLFNIAKPRPPWMGLLGPTIQAEVYDTVVITLKNMASHPVSLHAVGVSYW KASEGAEYDDQTSQREKEDDKVFPGGSHTYVWQVLKENGPMASDPLCLTYSYLSHVDLVK DLNSGLIGALLVCREGSLAKEKTQTLHKFILLFAVFDEGKSWHSETKNSLMQDRDAASARAW PKMHTVNGYVNRSLPGLIGCHRKSVYWHVIGMGTTPEVHSIFLEGHTFLVRNHRQASLEISPI TFLTAQTLLMDLGQFLLFCHISSHQHDGMEAYVKVDSCPEEPQLRMKNNEEAEDYDDDLTD SEMDVVRFDDDNSPSFIQIRSVAKKHPKTWVHYIAAEEEDWDYAPLVLAPDDRSYKSQYLNN GPQRIGRKYKKVRFMAYTDETFKTREAIQHESGILGPLLYGEVGDTLLIIFKNQASRPYNIYPH GITDVRPLYSRRLPKGVKHLKDFPILPGEIFKYKWTVTVEDGPTKSDPRCLTRYYSSFVNMER DLASGLIGPLLICYKESVDQRGNQIMSDKRNVILFSVFDENRSWYLTENIQRFLPNPAGVQLED PEFQASNIMHSINGYVFDSLQLSVCLHEVAYWYILSIGAQTDFLSVFFSGYTFKHKMVYEDTL TLFPFSGETVFMSMENPGLWILGCHNSDFRNRGMTALLKVSSCDKNTGDYYEDSYEDISAYL LSKNNAIEPRSFSQNGSPAGSPTSTEEGTSESATPESGPGTSTEPSEGSAPGSPAGSPTSTEEGTS TEPSEGSAPGTSTEPSEGSAPGTSESATPESGPGSEPATSGSETPGSEPATSGSETPGSPAGSPTS TEEGTSESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTSTEPSEGS APGTSTEPSEGSAPGTSESATPESGPGTSTEPSEGSPAGSPTSTEEGTSTEPSEGSAPGTSESGPGSEP ATSGSETPGTSESATPESGPGTSTEPSEGSAPGTSTEPSEGSAPGTSTEPSEGSAPGTSTEPSEGS APGTSTEPSEGSAPGTSTEPSEGSAPGSPAGSPTSTEEGTSTEPSEGSAPGTSESATPESGPGSEP ATSGSETPGTSESATPESGPGSEPATSGSETPGTSESATPESGPGTSTEPSEGSAPGTSESATPES GPGSPAGSPTSTEEGSPAGSPTSTEEGSPAGSPTSTEEGTSESATPESGPGTSTEPSEGSAPQSPR SFQKKTRHYFIAAVERLWDYGMSSSPHVLRNRAQSGSVPQFKKVVFQEFTDGSFTQPLYRGE LNEHLGLLGPYIRAEVEDNIMVTFRNQASRPYSFYSSLISYEEDQRQGAEPRKNFVKPNETKT YFWKVQHHMAPTKDEFDCKAWAYFSDVDLEKDVHSGLIGPLLVCHTNTLNPAHGRQVTVQ EFALFFTIFDETKSWYFTENMERNCRAPCNIQMEDPTFKENYRFHAINGYIMDTLPGLVMAQD QRIRWYLLSMGSNENIHSIHFSGHVFTVRKKEEYKMALYNLYPGVFETVEMLPSKAGIWRVE CLIGEHLHAGMSTLFLVYSNKCQTPLGMASGHIRDFQITASGQYGQWAPKLARLHYSGSINA WSTKEPFSWIKVDLLAPMIIHGIKTQGARQKFSSLYISQFIIMYSLDGKKWQTYRGNSTGTLM VFFGNVDSSGIKHNIFNPPIIARYIRLHPTHYSIRSTLRMELMGCDLNSCSMPLGMESKAISDAQ ITASSYFTNMFATWSPSKARLHLQGRSNAWRPQVNNPKEWLQVDFQKTMKVTGVTTQGVK SLLTSMYVKEFLISSSQDGHQWTLFFQNGKVKVFQGNQDSFTPVVNSLDPPLLTRYLRIHPQS WVHQIALRMEVLGCEAQDLYGPEGPSQSPRSFQGSPAGSPTSTEEGTSESATPESGPGTSTEPS EGSAPGSPAGSPTSTEEGTSTEPSEGSAPGTSTEPSEGSAPGTSESATPESGPGSEPATSGSETPG SEPATSGSETPGSPAGSPTSTEEGTSESATPESGPGTSTEPSEGSAPGTSTEPSEGSAPGSPAGSP TSTEEGTSTEPSEGSAPGTSTEPSEGSAPGTSESATPESGPGTSTEPSEGSAPGTSESATPESGPG SEPATSGSETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEPSEGSAPG TSTEPSEGSAPGTSTEPSEGSAPGTSTEPSEGSAPGSPAGSPTSTEEGTSTEPSEGSAPGTSTEPSE GSAPGTSESATPESGPGSEPATSGSETPGTSESATPESGPGSEPATSGSETPGTSESATPESGPGT STEPSEGSAPGTSESATPESGPGSPAGSPTSTEEGSPAGSPTSTEEGSPAGSPTSTEEGTSESATPE SGPGTSTEPSEGSAP |
| SP-AE576-CS-L-(FVIII_1-745)-AE576-(FVIII_1686-2332) | MQIELSTCFFLCLLRFCFSGSPAGSPTSTEEGTSESATPESGPGTSTEPSEGSAPGSPAGSPTSTEE GTSTEPSEGSAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTSTEPSEGSAP GTSTEPSEGSAPGTSESATPESGPGTSTEPSEGSAPGTSESATPESGPGSEPATSGSETPGTSTEPS EGSAPGTSTEPSEGSAPGTSESATPESGPGTSTEPSEGSAPGTSTEPSEGSAPGTSTEPSE GSAPGTSTEPSEGSAPGTSTEPSEGSAPGSPAGSPTSTEEGTSTEPSEGSAPGTSESATPESGPGS EPATSGSETPGTSESATPESGPGSEPATSGSETPGTSESATPESGPGTSTEPSEGSAPGTSESATP ESGPGSPAGSPTSTEEGSPAGSPTSTEEGSPAGSPTSTEEGTSESATPESGPGTSTEPSEGSAPQS PRSFQGPEGPSATRRYYLGAVELSWDYMQSDLGELPVDARFPPRVPKSFPFNTSVVYKKTLF VEFTVHLFNIAKPRPPWMGLLGPTIQAEVYDTVVITLKNMASHPVSLHAVGVSYWKASEGAE YDDQTSQREKEDDKVFPGGSHTYVWQVLKENGPMASDPLCLTYSYLSHVDLVKDLNSGLIG ALLVCREGSLAKEKTQTLHKFILLFAVFDEGKSWHSETKNSLMQDRDAASARAWPKMHTVN GYVNRSLPGLIGCHRKSVYWHVIGMGTTPEVHSIFLEGHTFLVRNHRQASLEISPITFLTAQTL LMDLGQFLLFCHISSHQHDGMEAYVKVDSCPEEPQLRMKNNEEAEDYDDDLTDSEMDVVRF DDDNSPSFIQIRSVAKKHPKTWVHYIAAEEEDWDYAPLVLAPDDRSYKSQYLNNGPQRIGRK YKKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLIG PLLICYKESVDQRGNQIMSDKRNVILFSVFDENRSWYLTENIQRFLPNPAGVQLEDPEFQASNI MHSINGYVFDSLQLSVCLHEVAYWYILSIGAQTDFLSVFFSGYTFKHKMVYEDTLTLFPFSGE TVFMSMENPGLWILGCHNSDFRNRGMTALLKVSSCDKNTGDYYEDSYEDISAYLLSKNNAIE PRSFSQNGSPAGSPTSTEEGTSESATPESGPGTSTEPSEGSAPGSPAGSPTSTEEGTSTEPSEGSA |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | PGTSTEPSEGSAPGTSESATPESGPGSEPATSGSETPGSEPATSGSETPGSPAGSPTSTEEGTSES<br>ATPESGPGTSTEPSEGSAPGTSTEPSEGSAPGPSPAGSPTSTEEGTSTEPSEGSAPGTSTEPSEGSA<br>PGTSESATPESGPGTSTEPSEGSAPGTSESATPESGPGSEPATSGSETPGTSTEPSEGSAPGTSTEP<br>SEGSAPGTSESATPESGPGTSESATPESGPGSPAGSPTSTEEGTSESATPESGPGSEPATSGSETP<br>GTSESATPESGPGTSTEPSEGSAPGTSTEPSEGSAPGTSTEPSEGSAPGTSTEPSEGSAPGTSTEPS<br>EGSAPGTSTEPSEGSAPGSPAGSPTSTEEGTSTEPSEGSAPGTSESATPESGPGSEPATSGSETPG<br>TSESATPESGPGSEPATSGSETPGTSESATPESGPGTSESATPESGPGSPAGSP<br>TSTEEGSPAGSPTSTEEGSPAGSPTSTEEGTSESATPESGPGTSTEPSEGSAPQSPRSFQKKTRHY<br>FIAAVERLWDYGMSSSPHVLRNRAQSGSVPQFKKVVFQEFTDGSFTQPLYRGELNEHLGLLG<br>PYIRAEVEDNIMVTFRNQASRPYSFYSSLISYEEDQRQGAEPRKNFVKPNETKTYFWKVQHH<br>MAPTKDEFDCKAWAYFSDVDLEKDVHSGLIGPLLVCHTNTLNPAHGRQVTVQEFALFFTIFD<br>ETKSWYFTENMERNCRAPCNIQMEDPTFKENYRFHAINGYIMDTLPGLVMAQDQRIRWYLLS<br>MGSNENIHSIHFSGHVFTVRKKEEYKMALYNLYPGVFETVEMLPSKAGIWRVECLIGEHLHA<br>GMSTLFLVYSNKCQTPLGMASGHIRDFQITASGQYGQWAPKLARLHYSGSINAWSTKEPFSW<br>IKVDLLAPMIIHGIKTQGARQKFSSLYISQFIIMYSLDGKKWQTYRGNSTGTLMVFFGNVDSSG<br>IKHNIFNPPIIARYIRLHPTHYSIRSTLRMELMGCDLNSCSMPLGMESKAISDAQITASSYFTNM<br>FATWSPSKARLHLQGRSNAWRPQVNNPKEWLQVDFQKTMKVTGVTTQGVKSLLTSMYVKE<br>FLISSSQDGHQWTLFFQNGKVKVFQGNQDSFTPVVNSLDPPLLTRYLRIHPQSWVHQIALRME<br>VLGCEAQDLY |
| SP-AE576-<br>CS-L-<br>(FVIII_1-<br>743)-<br>AE288-<br>(FVIII_1686-<br>2332)-L-<br>CS-AE576 | MQIELSTCFFLCLLRFCFSGSPAGSPTSTEEGTSESATPESGPGTSTEPSEGSAPGSPAGSPTSTEE<br>GTSTEPSEGSAPGTSTEPSEGSAPGTSESATPESGPGSEPATSGSETPGSEPATSGSETPGSPAGS<br>PTSTEEGTSESATPESGPGTSTEPSEGSAPGTSTEPSEGSAPGSPAGSPTSTEEGTSTEPSEGSAP<br>GTSTEPSEGSAPGTSESATPESGPGTSTEPSEGSAPGTSESATPESGPGSEPATSGSETPGTSTEPS<br>EGSAPGTSTEPSEGSAPGTSESATPESGPGTSESATPESGPGSPAGSPTSTEEGTSESATPESGPG<br>SEPATSGSETPGTSESATPESGPGTSTEPSEGSAPGTSTEPSEGSAPGTSTEPSEGSAPGTSTEPSE<br>GSAPGTSTEPSEGSAPGTSTEPSEGSAPGSPAGSPTSTEEGTSTEPSEGSAPGTSESATPESGPGS<br>EPATSGSETPGTSESATPESGPGSEPATSGSETPGSEPATSGSETPGSPGTSTEPSEGSAPGTSESATP<br>ESGPGSPAGSPTSTEEGSPAGSPTSTEEGSPAGSPTSTEEGTSESATPESGPGTSTEPSEGSAPIEP<br>RSPSGSPGATRRYYLGAVELSWDYMQSDLGELPVDARFPPRVPKSFPFNTSVVYKKTLFVEFT<br>VHLFNIAKPRPPWMGLLGPTIQAEVYDTVVITLKNMASHPVSLHAVGVSYWKASEGAEYDD<br>QTSQREKEDDKVFPGGSHTYVWQVLKENGPMASDPLCLTYSYLSHVDLVKDLNSGLIGALL<br>VCREGSLAKEKTQTLHKFILLFAVFDEGKSWHSETKNSLMQDRDAASARAWPKMHTVNGY<br>VNRSLPGLIGCHRKSVYWHVIGMGTTPEVHSIFLEGHTFLVRNHRQASLEISPITFLTAQTLLM<br>DLGQFLLFCHISSHQHDGMEAYVKVDSCPEEPQLRMKNNEEAEDYDDDLTDSEMDVVRFDD<br>DNSPSFIQIRSVAKKHPKTWVHYIAAEEEDWDYAPLVLAPDDRSYKSQYLNNGPQRIGRKYK<br>KVRFMAYTDETFKTREAIQHESGILGPLLYGEVGDTLLIIFKNQASRPYNIYPHGITDVRPLYSR<br>RLPKGVKHLKDFPILPGEIFKYKWTVTVEDGPTKSDPRCLTRYYSSFVNMERDLASGLIGPLLI<br>CYKESVDQRGNQIMSDKRNVILFSVFDENRSWYLTENIQRFLPNPAGVQLEDPEFQASNIMHS<br>INGYVFDSLQLSVCLHEVAYWYILSIGAQTDFLSVFFSGYTFKHKMVYEDTLTLFPFSGETVF<br>MSMENPGLWILGCHNSDFRNRGMTALLKVSSCDKNTGDYYEDSYEDISAYLLSKNNAIEPRS<br>FSGTSESATPESGPGSEPATSGSETPGTSESATPESGPGSEPATSGSETPGTSESATPESGPGTSTE<br>PSEGSAPGSPAGSPTSTEEGTSESATPESGPGSEPATSGSETPGTSESATPESGPGSPAGSPTSTE<br>EGSPAGSPTSTEEGTSTEPSEGSAPGTSESATPESGPGTSESATPESGPGSPAGSPGSEPA<br>TSGSETPGSEPATSGSETPGSPAGSPTSTEEGTSTEPSEGSAPGTSTEPSEGSAPGSEPATSGSETP<br>GTSESATPESGPGTSTEPSEGSAPQSPRSFQKKTRHYFIAAVERLWDYGMSSSPHVLRNRAQS<br>GSVPQFKKVVFQEFTDGSFTQPLYRGELNEHLGLLGPYIRAEVEDNIMVTFRNQASRPYSFYS<br>SLISYEEDQRQGAEPRKNFVKPNETKTYFWKVQHHMAPTKDEFDCKAWAYFSDVDLEKDV<br>HSGLIGPLLVCHTNTLNPAHGRQVTVQEFALFFTIFDETKSWYFTENMERNCRAPCNIQMEDP<br>TFKENYRFHAINGYIMDTLPGLVMAQDQRIRWYLLSMGSNENIHSIHFSGHVFTVRKKEEYK<br>MALYNLYPGVFETVEMLPSKAGIWRVECLIGEHLHAGMSTLFLVYSNKCQTPLGMASGHIRD<br>FQITASGQYGQWAPKLARLHYSGSINAWSTKEPFSWIKVDLLAPMIIHGIKTQGARQKFSSLYI<br>SQFIIMYSLDGKKWQTYRGNSTGTLMVFFGNVDSSGIKHNIFNPPIIARYIRLHPTHYSIRSTLR<br>MELMGCDLNSCSMPLGMESKAISDAQITASSYFTNMFATWSPSKARLHLQGRSNAWRPQVN<br>NPKEWLQVDFQKTMKVTGVTTQGVKSLLTSMYVKEFLISSSQDGHQWTLFFQNGKVKVFQG<br>NQDSFTPVVNSLDPPLLTRYLRIHPQSWVHQIALRMEVLGCEAQDLYGSPGIEPRSPSGSPAGS<br>PTSTEEGTSESATPESGPGTSTEPSEGSAPGSPAGSPTSTEEGTSTEPSEGSAPGTSTEPSEGSAP<br>GTSESATPESGPGSEPATSGSETPGSEPATSGSETPGSPAGSPTSTEEGTSESATPESGPGTSTEPS<br>EGSAPGTSTEPSEGSAPGSPAGSPTSTEEGTSTEPSEGSAPGTSTEPSEGSAPGTSESATPESGPG<br>TSTEPSEGSAPGTSESATPESGPGSEPATSGSETPGTSTEPSEGSAPGTSTEPSEGSAPGTSESATP<br>ESGPGTSESATPESGPGSPAGSPTSTEEGTSESATPESGPGSEPATSGSETPGTSESATPESGPGT<br>STEPSEGSAPGTSTEPSEGSAPGTSTEPSEGSAPGTSTEPSEGSAPGTSTEPSEGSAPGTSTEPSEG<br>SAPGSPAGSPTSTEEGTSTEPSEGSAPGTSESATPESGPGSEPATSGSETPGTSESATPESGPGSE<br>PATSGSETPGTSESATPESGPGTSTEPSEGSAPGTSESATPESGPGSPAGSPTSTEEGSPAGSPTS<br>TEEGSPAGSPTSTEEGTSESATPESGPGTSTEPSEGSAP |
| SP-AG288-<br>CS-L-<br>(FVIII_1-<br>743)-<br>AG576-<br>(FVIII_1686-<br>2332)-L-<br>CS-AG288 | MQIELSTCFFLCLLRFCFSPGASPGTSSTGSPGASPGTSSTGSPGTPGSGTASSSPGSSTPSGATG<br>SPGTPGSGTASSSPGSSTPSGATGSPGTPGSGTASSSPGSSTPSGATGSPGSSTPSGATGSPGSSP<br>SASTGTGPGSSPSASTGTGPGASPGTSSTGSPGASPGTSSTGSPGTPGSGTASSSPGSSTPSGATGSPGSSP<br>GPGSSPSASTGTGPGASPGTSSTGSPGASPGTSSTGSPGTPGSGTASSSPGSSPSASTGTGPGASP<br>GTSSTGSPGSSPSASTGTGPGTPGSGTASSSPGSSTPSGATGSIEPRSPSGSPGATRRYYLGAVEL<br>SWDYMQSDLGELPVDARFPPRVPKSFPFNTSVVYKKTLFVEFTVHLFNIAKPRPPWMGLLGP<br>TIQAEVYDTVVITLKNMASHPVSLHAVGVSYWKASEGAEYDDQTSQREKEDDKVFPGGSHT<br>YVWQVLKENGPMASDPLCLTYSYLSHVDLVKDLNSGLIGALLVCREGSLAKEKTQTLHKFIL |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | LFAVFDEGKSWHSETKNSLMQDRDAASARAWPKMHTVNGYVNRSLPGLIGCHRKSVYWHV IGMGTTPEVHSIFLEGHTFLVRNHRQASLEISPITFLTAQTLLMDLGQFLLFCHISSHQHDGME AYVKVDSCPEEPQLRMKNNEEAEDYDDDLTDSEMDVVRFDDDNSPSFIQIRSVAKKHPKTW VHYIAAEEEDWDYAPLVLAPDDRSYKSQYLNNGPQRIGRKYKKVRFMAYTDETFKTREAIQ HESGILGPLLYGEVGDTLLIIFKNQASRPYNIYPHGITDVRPLYSRRLPKGVKHLKDFPILPGEIF KYKWTVTVEDGPTKSDPRCLTRYYSSFVNMERDLASGLIGPLLICYKESVDQRGNQIMSDKR NVILFSVFDENRSWYLTENIQRFLPNPAGVQLEDPEFQASNIMHSINGYVFDSLQLSVCLHEVA YWYILSIGAQTDFLSVFFSGYTFKHKMVYEDTLTLFPFSGETVFMSMENPGLWILGCHNSDFR NRGMTALLKVSSCDKNTGDYYEDSYEDISAYLLSKNNAIEPRSFSPGTPGSGTASSSPGSSTPS GATGSPGSSPSASTGTGPGSSPSASTGTGPGSSTPSGATGSPGSSTPSGATGSPGASPGTSSTGSP GASPGTSSTGSPGASPGTSSTGSPGTPGSGTASSSPGASPGTSSTGSPGASPGTSSTGSPGASPGT SSTGSPGSSPSASTGTGPGTPGSGTASSSPGASPGTSSTGSPGASPGTSSTGSPGASPGTSSTGSP GSSTPSGATGSPGSSTPSGATGSPGASPGTSSTGSPGTPGSGTASSSPGSSTPSGATGSPGSSTPS GATGSPGSSTPSGATGSPGSSPSASTGTGPGASPGTSSTGSPGASPGTSSTGSPGTPGSGTASSSP GASPGTSSTGSPGASPGTSSTGSPGASPGTSSTGSPGTPGSGTASSSPGSSTPS GATGSPGTPGSGTASSSPGSSTPSGATGSPGTPGSGTASSSPGSSTPSGATGSPGSSTPSGATGSP GSSPSASTGTGPGSSPSASTGTGPGASPGTSSTGSPGTPGSGTASSSPGSSTPSGATGSPGSSPSA STGTGPGSSPSASTGTGPGASPGTSSTGSQSPRSFQKKTRHYFIAAVERLWDYGMSSSPHVLR NRAQSGSVPQFKKVVFQEFTDGSFTQPLYRGELNEHLGLLGPYIRAEVEDNIMVTFRNQASRP YSFYSSLISYEEDQRQGAEPRKNFVKPNETKTYFWKVQHHMAPTKDEFDCKAWAYFSDVDL EKDVHSGLIGPLLVCHTNTLNPAHGRQVTVQEFALFFTIFDETKSWYFTENMERNCRAPCNIQ MEDPTFKENYRFHAINGYIMDTLPGLVMAQDQRIRWYLLSMGSNENIHSIHFSGHVFTVRKK EEYKMALYNLYPGVFETVEMLPSKAGIWRVECLIGEHLHAGMSTLFLVYSNKCQTPLGMAS GHIRDFQITASGQYGQWAPKLARLHYSGSINAWSTKEPFSWIKVDLLAPMIIHGIKTQGARQK FSSLYISQFIIMYSLDGKKWQTYRGNSTGTLMVFFGNVDSSGIKHNIFNPPIIARYIRLHPTHYSI RSTLRMELMGCDLNSCSMPLGMESKAISDAQITASSYFTNMFATWSPSKARLHLQGRSNAW RPQVNNPKEWLQVDFQKTMKVTGVTTQGVKSLLTSMYVKEFLISSSQDGHQWTLFFQNGK VFQGNQDSFTPVVNSLDPPLLTRYLRIHPQSWVHQIALRMEVLGCEAQDLYGSPGQSPRSFQ PGASPGTSSTGSPGASPGTSSTGSPGTPGSGTASSSPGSSTPSGATGSPGTPGSGTASSSPGSSTP SGATGSPGTPGSGTASSSPGSSTPSGATGSPGSSTPSGATGSPGSSPSASTGTGPGSSPSASTGTG PGASPGTSSTGSPGTPGSGTASSSPGSSTPSGATGSPGSSPSASTGTGPGSSPSASTGTGPGASPG TSSTGSPGASPGTSSTGSPGSSTPSGATGSPGSSPSASTGTGPGASPGTSSTGSPGSSPSASTGTG PGTPGSGTASSSPGSSTPSGATGS |
| SP-AG576-CS-L-(FVIII_1-745)-AG288-(FVIII_1686-2332)-L-CS-AE576 | MQIELSTCFFLCLLRFCFSPGTPGSGTASSSPGSSTPSGATGSPGSSPSASTGTGPGSSPSASTGT GPGSSTPSGATGSPGSSTPSGATGSPGASPGTSSTGSPGASPGTSSTGSPGASPGTSSTGSPGTPG SGTASSSPGASPGTSSTGSPGASPGTSSTGSPGASPGTSSTGSPGSSPSASTGTGPGTPGSGTASS SPGASPGTSSTGSPGASPGTSSTGSPGASPGTSSTGSPGSSTPSGATGSPGSSTPSGATGSPGASP GTSSTGSPGTPGSGTASSSPGSSTPSGATGSPGSSTPSGATGSPGSSTPSGATGSPGSSPSASTGT GPGASPGTSSTGSPGASPGTSSTGSPGTPGSGTASSSPGASPGTSSTGSPGASPGTSSTGSPGASP GTSSTGSPGASPGTSSTGSPGTPGSGTASSSPGSSTPSGATGSPGTPGSGTASSSPGSSTPSGATG SPGTPGSGTASSSPGSSTPSGATGSPGSSTPSGATGSPGSSPSASTGTGPGSSPSASTGTGPGASP GTSSTGSPGTPGSGTASSSPGSSTPSGATGSPGSSPSASTGTGPGSSPSASTGTGPGASPGTSSTG SQSPRSFQGSPGATRRYYLGAVELSWDYMQSDLGELPVDARFPPRVPKSPPFNTSVVYKKTLF VEFTVHLFNIAKPRPPWMGLLGPTIQAEVYDTVVITLKNMASHPVSLHAVGVSYWKASEGAE YDDQTSQREKEDDKVFPGGSHTYVWQVLKENGPMASDPLCLTYSYLSHVDLVKDLNSGLIG ALLVCREGSLAKEKTQTLHKFILLFAVFDEGKSWHSETKNSLMQDRDAASARAWPKMHTVN GYVNRSLPGLIGCHRKSVYWHVIGMGTTPEVHSIFLEGHTFLVRNHRQASLEISPITFLTAQTL LMDLGQFLLFCHISSHQHDGMEAYVKVDSCPEEPQLRMKNNEEAEDYDDDLTDSEMDVVRF DDDNSPSFIQIRSVAKKHPKTWVHYIAAEEEDWDYAPLVLAPDDRSYKSQYLNNGPQRIGRK YKKVRFMAYTDETFKTREAIQHESGILGPLLYGEVGDTLLIIFKNQASRPYNIYPHGITDVRPL YSRRLPKGVKHLKDFPILPGEIFKYKWTVTVEDGPTKSDPRCLTRYYSSFVNMERDLASGLIG PLLICYKESVDQRGNQIMSDKRNVILFSVFDENRSWYLTENIQRFLPNPAGVQLEDPEFQASNI MHSINGYVFDSLQLSVCLHEVAYWYILSIGAQTDFLSVFFSGYTFKHKMVYEDTLTLFPFSGE TVFMSMENPGLWILGCHNSDFRNRGMTALLKVSSCDKNTGDYYEDSYEDISAYLLSKNNAIE PRSFSQNPGASPGTSSTGSPGASPGTSSTGSPGTPGSGTASSSPGSSTPSGATGSPGTPGSGTASS SPGSSTPSGATGSPGTPGSGTASSSPGSSTPSGATGSPGSSPSASTGTGPGASPGTSSTGSPGSSP SASTGTGPGASPGTSSTGSPGTPGSGTASSSPGSSTPSGATGSPGSSPSASTGTGPGSSPSASTGT GPGASPGTSSTGSPGASPGTSSTGSPGSSTPSGATGSPGSSPSASTGTGPGASPGTSSTGSPGSSP SASTGTGPGTPGSGTASSSPGSSTPSGATGSPQSPRSFQKKTRHYFIAAVERLWDYGMSSSPHVL RNRAQSGSVPQFKKVVFQEFTDGSFTQPLYRGELNEHLGLLGPYIRAEVEDNIMVTFRNQASR PYSFYSSLISYEEDQRQGAEPRKNFVKPNETKTYFWKVQHHMAPTKDEFDCKAWAYFSDVD LEKDVHSGLIGPLLVCHTNTLNPAHGRQVTVQEFALFFTIFDETKSWYFTENMERNCRAPCNI QMEDPTFKENYRFHAINGYIMDTLPGLVMAQDQRIRWYLLSMGSNENIHSIHFSGHVFTVRK KEEYKMALYNLYPGVFETVEMLPSKAGIWRVECLIGEHLHAGMSTLFLVYSNKCQTPLGMA SGHIRDFQITASGQYGQWAPKLARLHYSGSINAWSTKEPFSWIKVDLLAPMIIHGIKTQGARQ KFSSLYISQFIIMYSLDGKKWQTYRGNSTGTLMVFFGNVDSSGIKHNIFNPPIIARYIRLHPTHY SIRSTLRMELMGCDLNSCSMPLGMESKAISDAQITASSYFTNMFATWSPSKARLHLQGRSNA WRPQVNNPKEWLQVDFQKTMKVTGVTTQGVKSLLTSMYVKEFLISSSQDGHQWTLFFQNG KVKVFQGNQDSFTPVVNSLDPPLLTRYLRIHPQSWVHQIALRMEVLGCEAQDLYGSPGQSPR SFQGSPAGSPTSTEEGTSESATPESGPGTSTEPSEGSAPGSPAGSPTSTEEGTSTEPSEGSAPGTS TEPSEGSAPGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGSAPGTSE SATPESGPGTSTEPSEGSAPGTSESATPESGPGSEPATSGSETPGTSTEPSEGSAPGTSTEPSEGS |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | APGTSESATPESGPGTSESATPESGPGSPAGSPTSTEEGTSESATPESGPGSEPATSGSETPGTSE SATPESGPGTSTEPSEGSAPGTSTEPSEGSAPGTSTEPSEGSAPGTSTEPSEGSAPGTSTEPSEGS APGTSTEPSEGSAPGSPAGSPTSTEEGTSTEPSEGSAPGTSESATPESGPGSEPATSGSETPGTSE SATPESGPGSEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAP |
| SP-(FVIII_1-743)-AG576-(FVIII_1686-2332)-L-CS-AG576 | MQIELSTCFFLCLLRFCFSATRRYYLGAVELSWDYMQSDLGELPVDARFPPRVPKSFPFNTSV VYKKTLFVEFTVHLFNIAKPRPPWMGLLGPTIQAEVYDTVVITLKNMASHPVSLHAVGVSYW KASEGAEYDDQTSQREKEDDKVFPGGSHTYVWQVLKENGPMASDPLCLTYSYLSHVDLVK DLNSGLIGALLVCREGSLAKEKTQTLHKFILLFAVFDEGKSWHSETKNSLMQDRDAASARAW PKMHTVNGYVNRSLPGLIGCHRKSVYWHVIGMGTTPEVHSIFLEGHTFLVRNHRQASLEISPI TFLTAQTLLMDLGQFLLFCHISSHQHDGMEAYVKVDSCPEEPQLRMKNNEEAEDYDDDLTD SEMDVVRFDDDNSPSFIQIRSVAKKHPKTWVHYIAAEEEDWDYAPLVLAPDDRSYKSQYLNN GPQRIGRKYKKVRFMAYTDETFKTREAIQHESGILGPLLYGEVGDTLLIIFKNQASRPYNIYPH GITDVRPLYSRRLPKGVKHLKDFPILPGEIFKYKWTVTVEDGPTKSDPRCLTRYYSSFVNMER DLASGLIGPLLICYKESVDQRGNQIMSDKRNVILFSVFDENRSWYLTENIQRFLPNPAGVQLED PEFQASNIMHSINGYVFDSLQLSVCLHEVAYWYILSIGAQTDFLSVFFSGYTFKHKMVYEDTL TLFPFSGETVFMSMENPGLWILGCHNSDFRNRGMTALLKVSSCDKNTGDYYEDSYEDISAYL LSKNNAIEPRSFSPGTPGSGTASSSPGSSTPSGATGSPGSTPSGATGSPGSSPSASTGTGPGSSPSASTGTGPGSST PSGATGSPGSSTPSGATGSPGASPGTSSTGSPGASPGTSSTGSPGASPGTSSTGSPGTPGSGTASS SPGASPGTSSTGSPGASPGTSSTGSPGASPGTSSTGSPGSSPSASTGTGPGTPGSGTASSSPGASP GTSSTGSPGASPGTSSTGSPGASPGTSSTGSPGSSTPSGATGSPGSSTPSGATGSPGASPGTSSTG SPGTPGSGTASSSPGSSTPSGATGSPGSSTPSGATGSPGSSPSASTGTGPGASP GTSSTGSPGASPGTSSTGSPGTPGSGTASSSPGASPGTSSTGSPGASPGTSSTGSPGASPGTSSTG SPGASPGTSSTGSPGTPGSGTASSSPGSSTPSGATGSPGTPGSGTASSSPGSSTPSGATGSPGTPG SGTASSSPGSSTPSGATGSPGSSTPSGATGSPGSSPSASTGTGPGSSPSASTGTGPGASPGTSSTG SPGTPGSGTASSSPGSSTPSGATGSPGSSPSASTGTGPGSSPSASTGTGPGASPGTSSTGSQSPRS FQKKTRHYFIAAVERLWDYGMSSSPHVLRNRAQSGSVPQFKKVVFQEFTDGSFTQPLYRGEL NEHLGLLGPYIRAEVEDNIMVTFRNQASRPYSFYSSLISYEEDQRQGAEPRKNFVKPNETKTY FWKVQHHMAPTKDEFDCKAWAYFSDVDLEKDVHSGLIGPLLVCHTNTLNPAHGRQVTVQE FALFFTIFDETKSWYFTENMERNCRAPCNIQMEDPTFKENYRFHAINGYIMDTLPGLVMAQD QRIRWYLLSMGSNENIHSIHFSGHVFTVRKKEEYKMALYNLYPGVFETVEMLPSKAGIWRVE CLIGEHLHAGMSTLFLVYSNKCQTPLGMASGHIRDFQITASGQYGQWAPKLARLHYSGSINA WSTKEPFSWIKVDLLAPMIIHGIKTQGARQKFSSLYISQFIIMYSLDGKKWQTYRGNSTGTLM VFFGNVDSSGIKHNIFNPPIIARYIRLHPTHYSIRSTLRMELMGCDLNSCSMPLGMESKAISDAQ ITASSYFTNMFATWSPSKARLHLQGRSNAWRPQVNNPKEWLQVDFQKTMKVTGVTTQGVK SLLTSMYVKEFLISSSQDGHQWTLFFQNGKVKVFQGNQDSFTPVVNSLDPPLLTRYLRIHPQS WVHQIALRMEVLGCEAQDLYGSPGQSPRSFQPGTPGSGTASSSPGSSTPSGATGSPGSSPSAST GTGPGSSPSASTGTGPGSSTPSGATGSPGSSTPSGATGSPGASPGTSSTGSPGASPGTSSTGSPG ASPGTSSTGSPGTPGSGTASSSPGASPGTSSTGSPGASPGTSSTGSPGSSPSAS TGTGPGTPGSGTASSSPGASPGTSSTGSPGASPGTSSTGSPGASPGTSSTGSPGSSTPSGATGSPG SSTPSGATGSPGASPGTSSTGSPGTPGSGTASSSPGSSTPSGATGSPGSSTPSGATGSPGSSTPSG ATGSPGSSPSASTGTGPGASPGTSSTGSPGASPGTSSTGSPGTPGSGTASSSPGASPGTSSTGSPG ASPGTSSTGSPGASPGTSSTGSPGASPGTSSTGSPGATGSPGTPGSGTASSSPGASPGTSSTGSPGT ASSSPGSSTPSGATGSPGTPGSGTASSSPGSSTPSGATGSPGSSTPSGATGSPGSSPSASTGTGPG SSPSASTGTGPGASPGTSSTGSPGTPGSGTASSSPGSSTPSGATGSPGSSPSASTGTGPGSSPSAS TGTGPGASPGTSSTGS |
| SP-AG288-CS-L-(FVIII_1-743)-AG288-(FVIII_1686-2332)-L-CS-AE288 | MQIELSTCFFLCLLRFCFSPGASPGTSSTGSPGASPGTSSTGSPGTPGSGTASSSPGSSTPSGATG SPGTPGSGTASSSPGSSTPSGATGSPGTPGSGTASSSPGSSTPSGATGSPGSSTPSGATGSPGSSP SASTGTGPGSSPSASTGTGPGASPGTSSTGSPGTPGSGTASSSPGSSTPSGATGSPGSSPSASTGT GPGSSPSASTGTGPGASPGTSSTGSPGASPGTSSTGSPGSSPSASTGTGPGASP GTSSTGSPGSSPSASTGTGPGTPGSGTASSSPGSSTPSGATGSPGSQSPRSFQGPSGPATRRYYLGAV ELSWDYMQSDLGELPVDARFPPRVPKSFPFNTSVVYKKTLFVEFTVHLFNIAKPRPPWMGLL GPTIQAEVYDTVVITLKNMASHPVSLHAVGVSYWKASEGAEYDDQTSQREKEDDKVFPGGS HTYVWQVLKENGPMASDPLCLTYSYLSHVDLVKDLNSGLIGALLVCREGSLAKEKTQTLHK FILLFAVFDEGKSWHSETKNSLMQDRDAASARAWPKMHTVNGYVNRSLPGLIGCHRKSVY WHVIGMGTTPEVHSIFLEGHTFLVRNHRQASLEISPITFLTAQTLLMDLGQFLLFCHISSHQHDG MEAYVKVDSCPEEPQLRMKNNEEAEDYDDDLTDSEMDVVRFDDDNSPSFIQIRSVAKKHPK TWVHYIAAEEEDWDYAPLVLAPDDRSYKSQYLNNGPQRIGRKYKKVRFMAYTDETFKTREA IQHESGILGPLLYGEVGDTLLIIFKNQASRPYNIYPHGITDVRPLYSRRLPKGVKHLKDFPILPGE IFKYKWTVTVEDGPTKSDPRCLTRYYSSFVNMERDLASGLIGPLLICYKESVDQRGNQIMSDK RNVILFSVFDENRSWYLTENIQRFLPNPAGVQLEDPEFQASNIMHSINGYVFDSLQLSVCLHEV AYWYILSIGAQTDFLSVFFSGYTFKHKMVYEDTLTLFPFSGETVFMSMENPGLWILGCHNSDF RNRGMTALLKVSSCDKNTGDYYEDSYEDISAYLLSKNNAIEPRSFSPGASPGTSSTGSPGASPG TSSTGSPGTPGSGTASSSPGSSTPSGATGSPGTPGSGTASSSPGSSTPSGATGSPGTPGSGTASSS PGSSTPSGATGSPGSSTPSGATGSPGSSPSASTGTGPGSSPSASTGTGPGASPGTSSTGSPGTPGS GTASSSPGSSTPSGATGSPGSSPSASTGTGPGSSPSASTGTGPGASPGTSSTGSPGASPGTSSTGS PGSSTPSGATGSPGSSPSASTGTGPGASPGTSSTGSPGASPGTSSTGSPGTPGSGTASSSPGSSTP SGATGSPGSQSPRSFQKKTRHYFIAAVERLWDYGMSSSPHVLRNRAQSGSVPQFKKVVFQEFTDG SFTQPLYRGELNEHLGLLGPYIRAEVEDNIMVTFRNQASRPYSFYSSLISYEEDQRQGAEPRKN FVKPNETKTYFWKVQHHMAPTKDEFDCKAWAYFSDVDLEKDVHSGLIGPLLVCHTNTLNPA HGRQVTVQEFALFFTIFDETKSWYFTENMERNCRAPCNIQMEDPTFKENYRFHAINGYIMDTL PGLVMAQDQRIRWYLLSMGSNENIHSIHFSGHVFTVRKKEEYKMALYNLYPGVFETVEMLPS |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | KAGIWRVECLIGEHLHAGMSTLFLVYSNKCQTPLGMASGHIRDFQITASGQYGQWAPKLARL HYSGSINAWSTKEPFSWIKVDLLAPMIIHGIKTQGARQKFSSLYISQFIIMYSLDGKKWQTYRG NSTGTLMVFFGNVDSSGIKHNIFNPPIIARYIRLHPTHYSIRSTLRMELMGCDLNSCSMPLGME SKAISDAQITASSYFTNMFATWSPSKARLHLQGRSNAWRPQVNNPKEWLQVDFQKTMKVTG VTTQGVKSLLTSMYVKEFLISSSQDGHQWTLFFQNGKVKVFQGNQDSFTPVVNSLDPPLLTR YLRIHPQSWVHQIALRMEVLGCEAQDLYGPSGPQSPRSFQGTSESATPESGPGSEPATSGSETP GTSESATPESGPGSEPATSGSETPGTSESATPESGPGTSTEPSEGSAPGSPAGSPTSTEEGTSESA TPESGPGSEPATSGSETPGTSESATPESGPGSPAGSPTSTEEGTSAGSPTSTEEGTSTEPSEGSAP GTSESATPESGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTSTEPSEGSAP |
| SP-AE576-CS-L-(FVIII_1-743)-AG576-(FVIII_1686-2332) | MQIELSTCFFLCLLRFCFSGSPAGSPTSTEEGTSESATPESGPGTSTEPSEGSAPGSPAGSPTSTEE GTSTEPSEGSAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTSTEPSEGSAP GTSTEPSEGSAPGTSESATPESGPGSPAGSPTSTEEGTSAGSPTSTEEGTSGSETPGTSTEPS EGSAPGTSTEPSEGSAPGTSESATPESGPGTSESATPESGPGSPAGSPTSTEEGTSESATPESGPG SEPATSGSETPGTSESATPESGPGTSTEPSEGSAPGTSTEPSEGSAPGTSTEPSEGSAPGTSTEPSE GSAPGTSTEPSEGSAPGTSTEPSEGSAPGSPAGSPTSTEEGTSTEPSEGSAPGTSESATPESGPGS EPATSGSETPGTSESATPESGPGSEPATSGSETPGTSESAPGTSESATP ESGPGSPAGSPTSTEEGSPAGSPTSTEEGSPAGSPTSTEEGTSESATPESGPGTSTEPSEGSAPQS PRSFQGSPGATRRYYLGAVELSWDYMQSDLGELPVDARFPPRVPKSFPFNTSVVYKKTLFVE FTVHLFNIAKPRPPWMGLLGPTIQAEVYDTVVITLKNMASHPVSLHAVGVSYWKASEGAEYD DQTSQREKEDDKVFPGGSHTYVWQVLKENGPMASDPLCLTYSYLSHVDLVKDLNSGLIGAL LVCREGSLAKEKTQTLHKFILLFAVFDEGKSWHSETKNSLMQDRDAASARAWPKMHTVNGY VNRSLPGLIGCHRKSVYWHVIGMGTTPEVHSIFLEGHTFLVRNHRQASLEISPITFLTAQTLLM DLGQFLLFCHISSHQHDGMEAYVKVDSCPEEPQLRMKNNEEAEDYDDDLTDSEMDVVRFDD DNSPSFIQIRSVAKKHPKTWVHYIAAEEEDWDYAPLVLAPDDRSYKSQYLNNGPQRIGRKYK KVRFMAYTDETFKTREAIQHESGILGPLLYGEVGDTLLIIFKNQASRPYNIYPHGITDVRPLYSR RLPKGVKHLKDFPILPGEIFKYKWTVTVEDGPTKSDPRCLTRYYSSFVNMERDLASGLIGPLLI CYKESVDQRGNQIMSDKRNVILFSVFDENRSWYLTENIQRFLPNPAGVQLEDPEFQASNIMHS INGYVFDSLQLSVCLHEVAYWYILSIGAQTDFLSVFFSGYTFKHKMVYEDTLTLFPFSGETVF MSMENPGLWILGCHNSDFRNRGMTALLKVSSCDKNTGDYYEDSYEDISAYLLSKNNAIEPRS FSPGTPGSGTASSSPGSSTPSGATGSPGSSPSASTGTGPGSSPSASTGPGSSTPSGATGSPGSS TPSGATGSPGASPGTSSTGSPGASPGTSSTGSPGASPGTSSTGSPGTPGSGTASSSPGASPGTSST GSPGASPGTSSTGSPGASPGTSSTGSPGSSPSASTGTGPGTPGSGTASSSPGASPGTSSTGSPGAS PGTSSTGSPGASPGTSSTPGSSTPSGATGSPGSSTPSGATGSPGSSTPSGATGSPGSSPSASTGTGPGASPGTSSTGSPGAS PGTSSTGSPGTPGSGTASSSPGASPGTSSTGSPGASPGTSSTGSPGASPGTSSTGSPGASPGTSST GSPGTPGSGTASSSPGSSTPSGATGSPGTPGSGTASSSPGSSTPSGATGSPGSSTPSGATGSPGSS TPSGATGSPGSSTPSGATGSPGSSPSASTGTGPGSSPSASTGPGASPGTSSTGSPGTPGSGTAS SSPGSSTPSGATGSPGSSPSASTGTGPGASPGTSSTGSPQSPRSFQKKTRHYFIA AVERLWDYGMSSSPHVLRNRAQSGSVPQFKKVVFQEFTDGSFTQPLYRGELNEHLGLLGPYI RAEVEDNIMVTFRNQASRPYSFYSSLISYEEDQRQGAEPRKNFVKPNETKTYFWKVQHHMAP TKDEFDCKAWAYFSDVDLEKDVHSGLIGPLLVCHTNTLNPAHGRQVTVQEFALFFTIFDETKS WYFTENMERNCRAPCNIQMEDPTFKENYRFHAINGYIMDTLPGLVMAQDQRIRWYLLSMGS NENIHSIHFSGHVFTVRKKEEYKMALYNLYPGVFETVEMLPSKAGIWRVECLIGEHLHAGMS TLFLVYSNKCQTPLGMASGHIRDFQITASGQYGQWAPKLARLHYSGSINAWSTKEPFSWIKV DLLAPMIIHGIKTQGARQKFSSLYISQFIIMYSLDGKKWQTYRGNSTGTLMVFFGNVDSSGIKH NIFNPPIIARYIRLHPTHYSIRSTLRMELMGCDLNSCSMPLGMESKAISDAQITASSYFTNMFAT WSPSKARLHLQGRSNAWRPQVNNPKEWLQVDFQKTMKVTGVTTQGVKSLLTSMYVKEFLI SSSQDGHQWTLFFQNGKVKVFQGNQDSFTPVVNSLDPPLLTRYLRIHPQSWVHQIALRMEVL GCEAQDLY |
| FVIII BDD2 S367-FXIa-AE42-F368-Y2332-FXIa-AE864 | ATRRYYLGAVELSWDYMQSDLGELPVDARFPPRVPKSFPFNTSVVYKKTLFVEFTVHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNSSLPGL IGCHRKSVYWHVIGMGTTPEVHSIFLEGHTFLVRNHRQASLEISPITFLTAQTLLMDLGQFLLF CHISSHQHDGMEAYVKVDSCPEEPQLRMKNNEEAEDYDDDLTDSEMDVVRFDDDNSPSKLT RAETGEPSEGSAPGSPAGSPTSTEEGTSESATPESGPGSEPATSGSGFIQIRSVAKKHPKTWVHY IAAEEEDWDYAPLVLAPDDRSYKSQYLNNGPQRIGRKYKKVRFMAYTDETFKTREAIQHESGI ILGPLLYGEVGDTLLIIFKNQASRPYNIYPHGITDVRPLYSRRLPKGVKHLKDFPILPGEIFKYK WTVTVEDGPTKSDPRCLTRYYSSFVNMERDLASGLIGPLLICYKESVDQRGNQIMSDKRNVIL FSVFDENRSWYLTENIQRFLPNPAGVQLEDPEFQASNIMHSINGYVFDSLQLSVCLHEVAYWY ILSIGAQTDFLSVFFSGYTFKHKMVYEDTLTLFPFSGETVFMSMENPGLWILGCHNSDFRNRG MTALLKVSSCDKNTGDYYEDSYEDISAYLLSKNNAIEPRSFSQNPPVLKRHQREITRTTLQSD QEEIDYDDTISVEMKKEDFDIYDEDENQSPRSFQKKTRHYFIAAVERLWDYGMSSSPHVLRNR AQSGSVPQFKKVVFQEFTDGSFTQPLYRGELNEHLGLLGPYIRAEVEDNIMVTFRNQASRPYS FYSSLISYEEDQRQGAEPRKNFVKPNETKTYFWKVQHHMAPTKDEFDCKAWAYFSDVDLEK DVHSGLIGPLLVCHTNTLNPAHGRQVTVQEFALFFTIFDETKSWYFTENMERNCRAPCNIQME DPTFKENYRFHAINGYIMDTLPGLVMAQDQRIRWYLLSMGSNENIHSIHFSGHVFTVRKKEEY KMALYNLYPGVFETVEMLPSKAGIWRVECLIGEHLHAGMSTLFLVYSNKCQTPLGMASGHIR DFQITASGQYGQWAPKLARLHYSGSINAWSTKEPFSWIKVDLLAPMIIHGIKTQGARQKFSSL YISQFIIMYSLDGKKWQTYRGNSTGTLMVFFGNVDSSGIKHNIFNPPIIARYIRLHPTHYSIRSTL |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | RMELMGCDLNSCSMPLGMESKAISDAQITASSYFTNMFATWTPSKARLHLQGRSNAWRPQV<br>NNPKEWLQVDFQKTMKVTGVTTQGVKSLLTSMYVKEFLISSSQDGHQWTLFFQNGKVKVFQ<br>GNQDSFTPVVNSLDPPLLTRYLRIHPQSWVHQIALRMEVLGCEAQDLYKLTRAETGGSPAGSP<br>TSTEEGTSESATPESGPGTSTEPSEGSAPGSPAGSPTSTEEGTSTEPSEGSAPGTSTEPSEGSAPG<br>TSESATPESGPGSEPATSGSETPGSEPATSGSETPGSPAGSPTSTEEGTSESATPESGPGTSTEPSE<br>GSAPGTSTEPSEGSAPGSPAGSPTSTEEGTSTEPSEGSAPGTSTEPSEGSAPGTSESATPESGPGT<br>STEPSEGSAPGTSTEPSEGSAPGSEPATSGSETPGTSTEPSEGSAPGTSTEPSEGSAPGTSESATPE<br>SGPGTSESATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPGTSTEPSEGS<br>APGSPAGSPTSTEEGTSTEPSEGSAPGTSESATPESGPGSEPATSGSETPGTSESATPESGPGSEP<br>ATSGSETPGTSESATPESGPGTSTEPSEGSAPGTSESATPESGPGSPAGSPTSTEEGSPAGSPTST<br>EEGSPAGSPTSTEEGTSESATPESGPGTSTEPSEGSAPGTSESATPESGPGSEPATSGSETPGTSE<br>SATPESGPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGSAPGTSE<br>SATPESGPGTSESATPESGPGSESATPESGPGSEPATSGSETPGSEPATSGSETPGSPAGSPTST<br>EEGTSTEPSEGSAPGTSTEPSEGSAPGSEPATSGSETPGTSESATPESGPGTSTEPSEGSAP |
| FVIII BDD2 N745- FIXa- AG288- FIXa- P1640- Y2332- FIXa- AG864 | ATRRYYLGAVELSWDYMQSDLGELPVDARFPPRVPKSFPFNTSVVYKKTLFVEFTVHLFNIA<br>KPRPPWMGLLGPTIQAEVYDTVVITLKNMASHPVSLHAVGVSYWKASEGAEYDDQTSQREK<br>EDDKVFPGGSHTYVWQVLKENGPMASDPLCLTYSYLSHVDLVKDLNSGLIGALLVCREGSL<br>AKEKTQTLHKFILLFAVFDEGKSWHSETKNSLMQDRDAASARAWPKMHTVNGYVNRSLPGL<br>IGCHRKSVYWHVIGMGTTPEVHSIFLEGHTFLVRNHRQASLEISPITFLTAQTLLMDLGQFLLF<br>CHISSHQHDGMEAYVKVDSCPEEPQLRMKNNEEAEDYDDDLTDSEMDVVRFDDDNSPSFIQI<br>RSVAKKHPKTWVHYIAAEEEDWDYAPLVLAPDDRSYKSQYLNNGPQRIGRKYKKVRFMAY<br>TDETFKTREAIQHESGILGPLLYGEVGDTLLIIFKNQASRPYNIYPHGITDVRPLYSRRLPKGVK<br>HLKDFPILPGEIFKYKWTVTVEDGPTKSDPRCLTRYYSSFVNMERDLASGLIGPLLICYKESVD<br>QRGNQIMSDKRNVILFSVFDENRSWYLTENIQRFLPNPAGVQLEDPEFQASNIMHSINGYVFD<br>SLQLSVCLHEVAYWYILSIGAQTDFLSVFFSGYTFKHKMVYEDTLTLFPFSGETVFMSMENPG<br>LWILGCHNSDFRNRGMTALLKVSSCDKNTGDYYEDSYEDISAYLLSKNNAIEPRSFSQNPLGR<br>IVGGPGASPGTSSTGSPGASPGTSSTGSPGTPGSGTASSSPGSSTPSGATGSPGTPGSGTASSSPG<br>SSTPSGATGSPGTPGSGTASSSPGSSTPSGATGSPGSSTPSGATGSPGSSPSASTGTGPGSSPSAS<br>TGTGPGASPGTSSTGSPGTPGSGTASSSPGSSTPSGATGSPGSSPSASTGTGPGSSPSASTGTGPG<br>ASPGTSSTGSPGASPGTSSTGSPGSSTPSGATGSPGSSPSASTGTGPGASPGTSSTGSPGSSPSAS<br>TGTGPGTPGSGTASSSPGSSTPSGATGSGPLGRIVGGPPVLKRHQREITRTTLQSDQEEIDYDDT<br>ISVEMKKEDFDIYDEDENQSPRSFQKKTRHYFIAAVERLWDYGMSSSPHVLRNRAQSGSVPQ<br>FKKVVFQEFTDGSFTQPLYRGELNEHLGLLGPYISSLISYE<br>EDQRQGAEPRKNFVKPNETKTYFWKVQHHMAPTKDEFDCKAWAYFSDVDLEKDVHSGLIG<br>PLLVCHTNTLNPAHGRQVTVQEFALFFTIFDETKSWYFTENMERNCRAPCNIQMEDPTFKEN<br>YRFHAINGYIMDTLPGLVMAQDQRIRWYLLSMGSNENIHSIHFSGHVFTVRKKEEYKMALYN<br>LYPGVFETVEMLPSKAGIWRVECLIGEHLHAGMSTLFLVYSNKCQTPLGMASGHIRDFQITAS<br>GQYGQWAPKLARLHYSGSINAWSTKEPFSWIKVDLLAPMIIHGIKTQGARQKFSSLYISQFIIM<br>YSLDGKKWQTYRGNSTGTLMVFFGNVDSSGIKHNIFNPPIIARYIRLHPTHYSIRSTLRMELMG<br>CDLNSCSMPLGMESKAISDAQITASSYFTNMFATWSPSKARLHLQGRSNAWRPQVNNPKEW<br>LQVDFQKTMKVTGVTTQGVKSLLTSMYVKEFLISSSQDGHQWTLFFQNGKVKVFQGNQDSF<br>TPVVNSLDPPLLTRYLRIHPQSWVHQIALRMEVLGCEAQDLYPLGRIVGGGASPGTSSTGSPG<br>SSPSASTGTGPGSSPSASTGTGPGTPGSGTASSSPGSSTPSGATGSPGSSPSASTGTGPGASPGTS<br>STGSPGTPGSGTASSSPGSSTPSGATGSPGTPGSGTASSSPGASPGTSSTGSPGASPGTSSTGSPG<br>TPGSGTASSSPGSSTPSGATGSPGASPGTSSTGSPGTPGSGTASSSPGSSTPSGATGSPGSSPSAS<br>TGTGPGSSPSASTGTGPGSSTPSGATGSPGSSTPSGATGSPGASPGTSSTGSPGASPGTSSTGSPG<br>ASPGTSSTGSPGTPGSGTASSSPGASPGTSSTGSPGASPGTSSTGSPGASPGTSSTGSPGSSPSAS<br>TGTGPGTPGSGTASSSPGASPGTSSTGSPGASPGTSSTGSPGASPGTSSTGSPGSSTPSGATGSPG<br>SSTPSGATGSPGASPGTSSTGSPGTPGSGTASSSPGSSTPSGATGSPGSSTPSGATGSPGSSTPSG<br>ATGSPGSSPSASTGTGPGASPGTSSTGSPGASPGTSSTGSPGTPGSGTASSSPGASPGTSSTGSPG<br>ASPGTSSTGSPGASPGTSSTGSPGASPGTSSTGSPGTPGSGTASSSPGSSTPSGATGSPGTPGSGT<br>ASSSPGSSTPSGATGSPGTPGSGTASSSPGSSTPSGATGSPGSSTPSGATGSPGSSPSASTGTGPG<br>SSPSASTGTGPGASPGTSSTGSPGTPGSGTASSSPGSSTPSGATGSPGSSPSASTGTGPGSSPSAS<br>TGTGPGASPGTSSTGSPGASPGTSSTGSPGSSTPSGATGSPGSSPSASTGTGPGASPGTSSTGSPG<br>SSPSASTGTGPGTPGSGTASSSPGSSTPSGATGSPGSSTPSGATGSPGASPGTSSTGSP |
| FVIII BDD2 V128- FVIIa- AG42- FVIIa- G2044- FVIIa- AG144- Y2332- FVIIa- AG576 | ATRRYYLGAVELSWDYMQSDLGELPVDARFPPRVPKSFPFNTSVVYKKTLFVEFTVHLFNIA<br>KPRPPWMGLLGPTIQAEVYDTVVITLKNMASHPVSLHAVGVSYWKASEGAEYDDQTSQREK<br>EDDKVLQVRIVGGGAPSPSASTGTGPGTPGSGTASSSPGSSTPSGATGSPGPSGPGLQVRIVGG<br>FPGGSHTYVWQVLKENGPMASDPLCLTYSYLSHVDLVKDLNSGLIGALLVCREGSLAKEKTQ<br>TLHKFILLFAVFDEGKSWHSETKNSLMQDRDAASARAWPKMHTVNGYVNRSLPGLIGCHRK<br>SVYWHVIGMGTTPEVHSIFLEGHTFLVRNHRQASLEISPITFLTAQTLLMDLGQFLLFCHISSH<br>QHDGMEAYVKVDSCPEEPQLRMKNNEEAEDYDDDLTDSEMDVVRFDDDNSPSFIQIRSVAK<br>KHPKTWVHYIAAEEEDWDYAPLVLAPDDRSYKSQYLNNGPQRIGRKYKKVRFMAYTDETF<br>KTREAIQHESGILGPLLYGEVGDTLLIIFKNQASRPYNIYPHGITDVRPLYSRRLPKGVKHLKDF<br>PILPGEIFKYKWTVTVEDGPTKSDPRCLTRYYSSFVNMERDLASGLIGPLLICYKESVDQRGNQ<br>IMSDKRNVILFSVFDENRSWYLTENIQRFLPNPAGVQLEDPEFQASNIMHSINGYVFDSLQLSV<br>CLHEVAYWYILSIGAQTDFLSVFFSGYTFKHKMVYEDTLTLFPFSGETVFMSMENPGLWILGC<br>HNSDFRNRGMTALLKVSSCDKNTGDYYEDSYEDISAYLLSKNNAIEPRSFSQNPPVLKRHQRE<br>ITRTTLQSDQEEIDYDDTISVEMKKEDFDIYDEDENQSPRSFQKKTRHYFIAAVERLWDYGMS<br>SSPHVLRNRAQSGSVPQFKKVVFQEFTDGSFTQPLYRGELNEHLGLLGPYIRAEVEDNIMVTF |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | RNQASRPYSFYSSLISYEEDQRQGAEPRKNFVKPNETKTYFWKVQHHMAPTKDEFDCKAWA YFSDVDLEKDVHSGLIGPLLVCHTNTLNPAHGRQVTVQEFALFFTIFDETKSWYFTENMERNC RAPCNIQMEDPTFKENYRFHAINGYIMDTLPGLVMAQDQRIRWYLLSMGSNENIHSIHFSGHV FTVRKKEEYKMALYNLYPGVFETVEMLPSKAGIWRVECLIGEHLHAGMSTLFLVYSNKCQTP LGMASGHIRDFQITASGQYGLQVRIVGGSGTASSSPGSSTPSGATGSPGTPGSGTASSSPGSSTP SGATGSPGSSTPSGATGSPGSSPSASTGTGPGSSPSASTGTGPGASPGTSSTGSPGTPGSGTASSS PGSSTPSGATGSPGSSPSASTGTGPGSSPSASTGTGPGASPGLQVRIVGGQWAPKLARLHYSGS INAWSTKEPFSWIKVDLLAPMIIHGIKTQGARQKFSSLYISQFIIMYSLDGKKWQTYRGNSTGT LMVFFGNVDSSGIKHNIFNPPIIARYIRLHPTHYSIRSTLRMELMGCDLNSCSMPLGMESKAISD AQITASSYFTNMFATWSPSKARLHLQGRSNAWRPQVNNPKEWLQVDFQKTMKVTGVTTQG VKSLLTSMYVKEFLISSSQDGHQWTLFFQNGKVKVFQGNQDSFTPVVNSLDPPLLTRYLRIHP QSWVHQIALRMEVLGCEAQDLYLQVRIVGGPGTPGSGTASSSPGSSTPSGATGSPGSSPSAST GTGPGSSPSASTGTGPGSSTPSGATGSPGSSTPSGATGSPGASPGTSSTGSPGASPGTSSTGSPG ASPGTSSTGSPGTPGSGTASSSPGASPGTSSTGSPGASPGTSSTGSPGASPGTSSTGSPGSSPSAS TGTGPGTPGSGTASSSPGASPGTSSTGSPGASPGTSSTGSPGSSTPSGATGSPG SSTPSGATGSPGASPGTSSTGSPGTPGSGTASSSPGSSTPSGATGSPGSSTPSGATGSPGSSTPSG ATGSPGSSPSASTGTGPGASPGTSSTGSPGASPGTSSTGSPGTPGSGTASSSPGASPGTSSTGSPG ASPGTSSTGSPGASPGTSSTGSPGASPGTSSTGSPGTPGSGTASSSPGSSTPSGATGSPGTPGSGT ASSSPGSSTPSGATGSPGTPGSGTASSSPGSSTPSGATGSPGSSTPSGATGSPGSSPSASTGTGPG SSPSASTGTGPGASPGTSSTGSPGTPGSGTASSSPGSSTPSGATGSPGSSPSASTGTGPGSSPSAS TGTGPGASPGTSSTGS |
| AE864-FVIII-Thrombin-AE144 | GSPAGSPTSTEEGTSESATPESGPGTSTEPSEGSAPGSPAGSPTSTEEGTSTEPSEGSAPGTSTEPS EGSAPGTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGSAPGTSTEPSEGSAPGT SESATPESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPGSEPATSGSE TPGTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGSA PGTSESATPESGPGTSESATPESGPGSEPATSGSETPGSEPATSGSETPGSPAG SPTSTEEGTSTEPSEGSAPGTSTEPSEGSAPGSEPATSGSETPGTSESATPESGPGTSTEPSEGSAP GATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQRE KEDDKVFPGGSHTYVWQVLKENGPMASDPLCLTYSYLSHVDLVKDLNSGLIGALLVCREGS LAKEKTQTLHKFILLFAVFDEGKSWHSETKNSLMQDRDAASARAWPKMHTVNGYVNRSLPG LIGCHRKSVYWHVIGMGTTPEVHSIFLEGHTFLVRNHRQASLEISPITFLTAQTLLMDLGQFLL FCHISSHQHDGMEAYVKVDSCPEEPQLRMKNNEEAEDYDDDLTDSEMDVVRFDDDNSPSFIQ IRSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSMENPG LWILGCHNSDFRNRGMTALLKVSSCDKNTGDYYEDSYEDISAYLLSKNNAIEPRSFSQNSRHP STRQKQFNATTIPENDIEKTDPWFAHRTPMPKIQNVSSSDLLMLLRQSPTPHGLSLSDLQEAKY ETFSDDPSPGAIDSNNSLSEMTHFRPQLHHSGDMVFTPESGLQLRLNEKLGTTAATELKKLDF KVSSTSNNLISTIPSDNLAAGTDNTSSLGPPSMPVHYDSQLDTTLFGKKSSPLTESGGPLSLSEE NNDSKLLESGLMNSQESSWGKNVSSTESGRLFKGKRAHGPALLTKDNALFKVSISLLKTNKT SNNSATNRKTHIDGPSLLIENSPSVWQNILESDTEFKKVTPLIHDRMLMDKNATALRLNHMSN KTTSSKNMEMVQQKKEGPIPPDAQNPDMSFFKMLFLPESARWIQRTHGKNSLNSGQGPSPKQ LVSLGPEKSVEGQNFLSEKNKVVVGKGEFTKDVGLKEMVFPSSRNLFLTNLDNLHENNTHNQ EKKIQEEIEKKETLIQENVVLPQIHTVTGTKNFMKNLFLLSTRQNVEGSYDGAYAPVLQDFRS LNDSTNRTKKHTAHFSKKGEEENLEGLGNQTKQIVEKYACTTRISPNTSQQNFVTQRSKRAL KQFRLPLEETELEKRIIVDDTSTQWSKNMKHLTPSTLTQIDYNEKEKGAITQSPLSDCLTRSHSI PQANRSPLPIAKVSSFPSIRPIYLTRVLFQDNSSHLPAASYRKKDSGVQESSHFLQGAKKNNLS LAILTLEMTGDQREVGSLGTSATNSVTYKKVENTVLPKPDLPKTSGKVELLPKVHIYQKDLFP TETSNGSPGHLDLVEGSLLQGTEGAIKWNEANRPGKVPFLRVATESSAKTPSKLLDPLAWDN HYGTQIPKEEWKSQEKSPEKTAFKKKDTILSLNACESNHAIAAINEGQNKPEIEVTWAKQGRT ERLCSQNPPVLKRHQREITRTTLQSDQEEIDYDDTISVEMKKEDFDIYDEDENQSPRSFQKKTR HYFIAAVERLWDYGMSSSPHVLRNRAQSGSVPQFKKVVFQEFTDGSFTQPLYRGELNEHLGL LGPYIRAEVEDNIMVTFRNQASRPYSFYSSLISYEEDQRQGAEPRKNFVKPNETKTYFWKVQH HMAPTKDEFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQDQRIRWYL LSMGSNENIHSIHFSGHVFTVRKKEEYKMALYNLYPGVFETVEMLPSKAGIWRVECLIGEHLH AGMSTLFLVYSNKCQTPLGMASGHIRDFQITASGQYGQWAPKLARLHYSGSINAWSTKEPFS WIKVDLLAPMIIHGIKTQGARQKFSSLYISQFIIMYSLDGKKWQTYRGNSTGTLMVFFGNVDS SGIKHNIFNPPIIARYIRLHPTHYSIRSTLRMELMGCDLNSCSMPLGMESKAISDAQITASSYFTN MFATWSPSKARLHLQGRSNAWRPQVNNPKEWLQVDFQKTMKVTGVTTQGVKSLLTSMYV |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | KEFLISSSQDGHQWTLFFQNGKVKVFQGNQDSFTPVVNSLDPPLLTRYLRIHPQSWVHQIALR<br>MEVLGCEAQDLYGLTPRSLLVGGSEPATSGSETPGTSESATPESGPGSEPATSGSETPGSPAGS<br>PTSTEEGTSTEPSEGSAPGSEPATSGSETPGSEPATSGSETPGSEPATSGSETPGTSTEPSEGSAP<br>GTSESATPESGPGSEPATSGSETPGTSTEPSEGSAP |
| FVIII BDD3-FXIIa-AE144 | ATRRYYLGAVELSWDYMQSDLGELPVDARFPPRVPKSFPFNTSVVYKKTLFVEFTVHLFNIA<br>KPRPPWMGLLGPTIQAEVYDTVVITLKNMASHPVSLHAVGVSYWKASEGAEYDDQTSQREK<br>EDDKVFPGGSHTYVWQVLKENGPMASDPLCLTYSYLSHVDLVKDLNSGLIGALLVCREGSL<br>AKEKTQTLHKFILLFAVFDEGKSWHSETKNSLMQDRDAASARAWPKMHTVNGYVNRSLPGL<br>IGCHRKSVYWHVIGMGTTPEVHSIFLEGHTFLVRNHRQASLEISPITFLTAQTLLMDLGQFLLF<br>CHISSSHQHDGMEAYVKVDSCPEEPQLRMKNNEEAEDYDDDLTDSEMDVVRFDDDNSPSFIQI<br>RSVAKKHPKTWVHYIAAEEEDWDYAPLVLAPDDRSYKSQYLNNGPQRIGRKYKKVRFMAY<br>TDETFKTREAIQHESGILGPLLYGEVGDTLLIIFKNQASRPYNIYPHGITDVRPLYSRRLPKGVK<br>HLKDFPILPGEIFKYKWTVTVEDGPTKSDPRCLTRYYSSFVNMERDLASGLIGPLLICYKESVD<br>QRGNQIMSDKRNVILFSVFDENRSWYLTENIQRFLPNPAGVQLEDPEFQASNIMHSINGYVFD<br>SLQLSVCLHEVAYWYILSIGAQTDFLSVFFSGYTFKHKMVYEDTLTLFPFSGETVFMSMENPG<br>LWILGCHNSDFRNRGMTALLKVSSCDKNTGDYYEDSYEDISAYLLSKNNAIEPRSFSQNPPVL<br>KRHQGEITRTTLQSDQEEIDYDDTISVEMKKEDFDIYDEDENQSPRSFQKKTRHYFIAAVERL<br>WDYGMSSSPHVLRNRAQSGSVPQFKKVVFQEFTDGSFTQPLYRGELNEHLGLLGPYIRAEVE<br>DNIMVTFRNQASRPYSFYSSLISYEEDQRQGAEPRKNFVKPNETKTYFWKVQHHMAPTKDEF<br>DCKAWAYFSDVDLEKDVHSGLIGPLLVCHTNTLNPAHGRQVTVQEFALFFTIFDETKSWYFT<br>ENMERNCRAPCNIQMEDPTFKENYRFHAINGYIMDTLPGLVMAQDQRIRWYLLSMGSNENIH<br>SIHFSGHVFTVRKKEEYKMALYNLYPGVFETVEMLPSKAGIWRVECLIGEHLHAGMSTLFLV<br>YSNKCQTPLGMASGHIRDFQITASGQYGQWAPKLARLHYSGSINAWSTKEPFSWIKVDLLAP<br>MIIHGIKTQGARQKFSSLYISQFIIMYSLDGKKWQTYRGNSTGTLMVFFGNVDSSGIKHNIFNP<br>PIIARYIRLHPTHYSIRSTLRMELMGCDLNSCSMPLGMESKAISDAQITASSYFTNMFATWSPS<br>KARLHLQGRSNAWRPQVNNPKEWLQVDFQKTMKVTGVTTQGVKSLLTSMYVKEFLISSSQD<br>GHQWTLFFQNGKVKVFQGNQDSFTPVVNSLDPPLLTRYLRIHPQSWVHQIALRMEVLGCEA<br>QDLYGTMTRIVGGGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEGSAPGTSESATPES<br>GPGSEPATSGSETPGTSTEPSEGSAP |
| FVIII BDD3-Elastase-AE144 | ATRRYYLGAVELSWDYMQSDLGELPVDARFPPRVPKSFPFNTSVVYKKTLFVEFTVHLFNIA<br>KPRPPWMGLLGPTIQAEVYDTVVITLKNMASHPVSLHAVGVSYWKASEGAEYDDQTSQREK<br>EDDKVFPGGSHTYVWQVLKENGPMASDPLCLTYSYLSHVDLVKDLNSGLIGALLVCREGSL<br>AKEKTQTLHKFILLFAVFDEGKSWHSETKNSLMQDRDAASARAWPKMHTVNGYVNRSLPGL<br>IGCHRKSVYWHVIGMGTTPEVHSIFLEGHTFLVRNHRQASLEISPITFLTAQTLLMDLGQFLLF<br>CHISSSHQHDGMEAYVKVDSCPEEPQLRMKNNEEAEDYDDDLTDSEMDVVRFDDDNSPSFIQI<br>RSVAKKHPKTWVHYIAAEEEDWDYAPLVLAPDDRSYKSQYLNNGPQRIGRKYKKVRFMAY<br>TDETFKTREAIQHESGILGPLLYGEVGDTLLIIFKNQASRPYNIYPHGITDVRPLYSRRLPKGVK<br>HLKDFPILPGEIFKYKWTVTVEDGPTKSDPRCLTRYYSSFVNMERDLASGLIGPLLICYKESVD<br>QRGNQIMSDKRNVILFSVFDENRSWYLTENIQRFLPNPAGVQLEDPEFQASNIMHSINGYVFD<br>SLQLSVCLHEVAYWYILSIGAQTDFLSVFFSGYTFKHKMVYEDTLTLFPFSGETVFMSMENPG<br>LWILGCHNSDFRNRGMTALLKVSSCDKNTGDYYEDSYEDISAYLLSKNNAIEPRSFSQNPPVL<br>KRHQGEITRTTLQSDQEEIDYDDTISVEMKKEDFDIYDEDENQSPRSFQKKTRHYFIAAVERL<br>WDYGMSSSPHVLRNRAQSGSVPQFKKVVFQEFTDGSFTQPLYRGELNEHLGLLGPYIRAEVE<br>DNIMVTFRNQASRPYSFYSSLISYEEDQRQGAEPRKNFVKPNETKTYFWKVQHHMAPTKDEF<br>DCKAWAYFSDVDLEKDVHSGLIGPLLVCHTNTLNPAHGRQVTVQEFALFFTIFDETKSWYFT<br>ENMERNCRAPCNIQMEDPTFKENYRFHAINGYIMDTLPGLVMAQDQRIRWYLLSMGSNENIH<br>SIHFSGHVFTVRKKEEYKMALYNLYPGVFETVEMLPSKAGIWRVECLIGEHLHAGMSTLFLV<br>YSNKCQTPLGMASGHIRDFQITASGQYGQWAPKLARLHYSGSINAWSTKEPFSWIKVDLLAP<br>MIIHGIKTQGARQKFSSLYISQFIIMYSLDGKKWQTYRGNSTGTLMVFFGNVDSSGIKHNIFNP<br>PIIARYIRLHPTHYSIRSTLRMELMGCDLNSCSMPLGMESKAISDAQITASSYFTNMFATWSPS<br>KARLHLQGRSNAWRPQVNNPKEWLQVDFQKTMKVTGVTTQGVKSLLTSMYVKEFLISSSQD<br>GHQWTLFFQNGKVKVFQGNQDSFTPVVNSLDPPLLTRYLRIHPQSWVHQIALRMEVLGCEA<br>QDLYGGGSEPATSGSETPGTSESATPESGPGSEPATSGSETPGSPAGSPTSTEEGTSTEPSEGSAP<br>GSEPATSGSETPGSEPATSGSETPGSEPATSGSETPGTSTEPSEGSAPGTSESATPESGPGSEPAT<br>SGSETPGTSTEPSEGSAP |
| FVIII BDD3-FXIa-AE144 | ATRRYYLGAVELSWDYMQSDLGELPVDARFPPRVPKSFPFNTSVVYKKTLFVEFTVHLFNIA<br>KPRPPWMGLLGPTIQAEVYDTVVITLKNMASHPVSLHAVGVSYWKASEGAEYDDQTSQREK<br>EDDKVFPGGSHTYVWQVLKENGPMASDPLCLTYSYLSHVDLVKDLNSGLIGALLVCREGSL<br>AKEKTQTLHKFILLFAVFDEGKSWHSETKNSLMQDRDAASARAWPKMHTVNGYVNRSLPGL<br>IGCHRKSVYWHVIGMGTTPEVHSIFLEGHTFLVRNHRQASLEISPITFLTAQTLLMDLGQFLLF<br>CHISSSHQHDGMEAYVKVDSCPEEPQLRMKNNEEAEDYDDDLTDSEMDVVRFDDDNSPSFIQI<br>RSVAKKHPKTWVHYIAAEEEDWDYAPLVLAPDDRSYKSQYLNNGPQRIGRKYKKVRFMAY<br>TDETFKTREAIQHESGILGPLLYGEVGDTLLIIFKNQASRPYNIYPHGITDVRPLYSRRLPKGVK<br>HLKDFPILPGEIFKYKWTVTVEDGPTKSDPRCLTRYYSSFVNMERDLASGLIGPLLICYKESVD<br>QRGNQIMSDKRNVILFSVFDENRSWYLTENIQRFLPNPAGVQLEDPEFQASNIMHSINGYVFD<br>SLQLSVCLHEVAYWYILSIGAQTDFLSVFFSGYTFKHKMVYEDTLTLFPFSGETVFMSMENPG<br>LWILGCHNSDFRNRGMTALLKVSSCDKNTGDYYEDSYEDISAYLLSKNNAIEPRSFSQNPPVL<br>KRHQGEITRTTLQSDQEEIDYDDTISVEMKKEDFDIYDEDENQSPRSFQKKTRHYFIAAVERL<br>WDYGMSSSPHVLRNRAQSGSVPQFKKVVFQEFTDGSFTQPLYRGELNEHLGLLGPYIRAEVE<br>DNIMVTFRNQASRPYSFYSSLISYEEDQRQGAEPRKNFVKPNETKTYFWKVQHHMAPTKDEF |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | DCKAWAYFSDVDLEKDVHSGLIGPLLVCHTNTLNPAHGRQVTVQEFALFFTIFDETKSWYFT ENMERNCRAPCNIQMEDPTFKENYRFHAINGYIMDTLPGLVMAQDQRIRWYLLSMGSNENIH SIHFSGHVFTVRKKEEYKMALYNLYPGVFETVEMLPSKAGIWRVECLIGEHLHAGMSTLFLV YSNKCQTPLGMASGHIRDFQITASGQYGQWAPKLARLHYSGSINAWSTKEPFSWIKVDLLAP MIIHGIKTQGARQKFSSLYISQFIIMYSLDGKKWQTYRGNSTGTLMVFFGNVDSSGIKHNIFNP PIIARYIRLHPTHYSIRSTLRMELMGCDLNSCSMPLGMESKAISDAQITASSYFTNMFATWSPS KARLHLQGRSNAWRPQVNNPKEWLQVDFQKTMKVTGVTTQGVKSLLTSMYVKEFLISSSQD GHQWTLFFQNGKVKVFQGNQDSFTPVVNSLDPPLLTRYLRIHPQSWVHQIALRMEVLGCEA QDLYGKLTRAETGGSEPATSGSETPGTSESATPESGPGSEPATSGSETPGSPAGSPTSEEGTST EPSEGSAPGSEPATSGSETPGSEPATSGSETPGSEPATSGSETPGTSTEPSEGSAPGTSESATPES GPGSEPATSGSETPGTSTEPSEGSAP |
| FVIII BDD3-Thrombin-AE144 | ATRRYYLGAVELSWDYMQSDLGELPVDARFPPRVPKSFPFNTSVVYKKTLFVEFTVHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSMENPG LWILGCHNSDFRNRGMTALLKVSSCDKNTGDYYEDSYEDISAYLLSKNNAIEPRSFSQNPPVL KRHQGEITRTTLQSDQEEIDYDDTISVEMKKEDFDIYDEDENQSPRSFQKKTRHYFIAAVERL WDYGMSSSPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHHMAPTKDEF DCKAWAYFSDVDLEKDVHSGLIGPLLVCHTNTLNPAHGRQVTVQEFALFFTIFDETKSWYFT ENMERNCRAPCNIQMEDPTFKENYRFHAINGYIMDTLPGLVMAQDQRIRWYLLSMGSNENIH SIHFSGHVFTVRKKEEYKMALYNLYPGVFETVEMLPSKAGIWRVECLIGEHLHAGMSTLFLV YSNKCQTPLGMASGHIRDFQITASGQYGQWAPKLARLHYSGSINAWSTKEPFSWIKVDLLAP MIIHGIKTQGARQKFSSLYISQFIIMYSLDGKKWQTYRGNSTGTLMVFFGNVDSSGIKHNIFNP PIIARYIRLHPTHYSIRSTLRMELMGCDLNSCSMPLGMESKAISDAQITASSYFTNMFATWSPS KARLHLQGRSNAWRPQVNNPKEWLQVDFQKTMKVTGVTTQGVKSLLTSMYVKEFLISSSQD GHQWTLFFQNGKVKVFQGNQDSFTPVVNSLDPPLLTRYLRIHPQSWVHQIALRMEVLGCEA QDLYGLTPRSLLVGGSEPATSGSETPGTSESATPESGPGSEPATSGSETPGSPAGSPTSEEGTS TEPSEGSAPGSEPATSGSETPGSEPATSGSETPGSEPATSGSETPGTSTEPSEGSAPGTSESATPES GPGSEPATSGSETPGTSTEPSEGSAP |
| AE144-FVIII BDD2-MMP-17-AE864 | GSEPATSGSETPGTSESATPESGPGSEPATSGSETPGSPAGSPTSEEGTSTEPSEGSAPGSEPAT SGSETPGSEPATSGSETPGSEPATSGSETPGTSTEPSEGSAPGTSESATPESGPGSEPATSGSETP GTSTEPSEGSAPGATRRYYLGAVELSWDYMQSDLGELPVDARFPPRVPKSFPFNTSVVYKKT LFVEFTVHLFNIAKPRPPWMGLLGPTIQAEVYDTVVITLKNMASHPVSLHAVGVSYWKASEG AEYDDQTSQREKEDDKVFPGGSHTYVWQVLKENGPMASDPLCLTYSYLSHVDLVKDLNSGL IGALLVCREGSLAKEKTQTLHKFILLFAVFDEGKSWHSETKNSLMQDRDAASARAWPKMHT VNGYVNRSLPGLIGCHRKSVYWHVIGMGTTPEVHSIFLEGHTFLVRNHRQASLEISPITFLTAQ TLLMDLGQFLLFCHISSHQHDGMEAYVKVDSCPEEPQLRMKNNEEAEDYDDDLTDSEMDVV RFDDDNSPSFIQIRSVAKKHPKTWVHYIAAEEEDWDYAPLVLAPDDRSYKSQYLNNGPQRIG RKYKKVRFMAYTDETFKTREAIQHESGILGPLLYGEVGDTLLIIFKNQASRPYNIYPHGITDVR PLYSRRLPKGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQLEDPEFQAS NIMHSINGYVFDSLQLSVCLHEVAYWYILSIGAQTDFLSVFFSGYTFKHKMVYEDTLTLFPFS GETVFMSMENPGLWILGCHNSDFRNRGMTALLKVSSCDKNTGDYYEDSYEDISAYLLSKNN AIEPRSFSQNPPVLKRHQREITRTTLQSDQEEIDYDDTISVEMKKEDFDIYDEDENQSPRSFQKK TRHYFIAAVERLWDYGMSSSPHVLRNRAQSGSVPQFKKVVFQEFTDGSFTQPLYRGELNEHL GLLGPYIRAEVEDNIMVTFRNQASRPYSFYSSLISYEEDQRQGAEPRKNFVKPNETKTYFWKV QHHMAPTKDEFDCKAWAYFSDVDLEKDVHSGLIGPLLVCHTNTLNPAHGRQVTVQEFALFF TIFDETKSWYFTENMERNCRAPCNIQMEDPTFKENYRFHAINGYIMDTLPGLVMAQDQRIRW YLLSMGSNENIHSIHFSGHVFTVRKKEEYKMALYNLYPGVFETVEMLPSKAGIWRVECLIGEH LHAGMSTLFLVYSNKCQTPLGMASGHIRDFQITASGQYGQWAPKLARLHYSGSINAWSTKEP FSWIKVDLLAPMIIHGIKTQGARQKFSSLYISQFIIMYSLDGKKWQTYRGNSTGTLMVFFGNV DSSGIKHNIFNPPIIARYIRLHPTHYSIRSTLRMELMGCDLNSCSMPLGMESKAISDAQITASYF TNMFATWSPSKARLHLQGRSNAWRPQVNNPKEWLQVDFQKTMKVTGVTTQGVKSLLTSM YVKEFLISSSQDGHQWTLFFQNGKVKVFQGNQDSFTPVVNSLDPPLLTRYLRIHPQSWVHQIA LRMEVLGCEAQDLYGAPLGLRLRGGSPAGSPTSEEGTSESATPESGPGTSTEPSEGSAPGSPA GSPTSEEGTSTEPSEGSAPGTSTEPSEGSAPGTSESATPESGPGSEPATSGSETPGSEPATSGSE TPGSPAGSPTSEEGTSESATPESGPGTSTEPSEGSAPGTSTEPSEGSAPGSPAGSPTSEEGTST EPSEGSAPGTSTEPSEGSAPGTSESATPESGPGTSTEPSEGSAPGTSESATPESGPGSEPATSGSE TPGTSTEPSEGSAPGTSTEPSEGSAPGTSESATPESGPGTSTEPSEGSAPGTSTEPSEGTSEESS ATPESGPGSEPATSGSETPGTSESATPESGPGTSTEPSEGSAPGTSTEPSEGSAPGTSTEPSEGSA PGTSTEPSEGSAPGTSTEPSEGSAPGTSTEPSEGSAPGSPAGSPTSEEGTSTEPSEGSAPGTSES ATPESGPGSEPATSGSETPGTSESATPESGPGSEPATSGSETPGTSESATPESGPGTSTEPSEGSA PGTSESATPESGPGSPAGSPTSEEGSPAGSPTSEEGSPAGSPTSEEGTSESATPESGPGTSTEP SEGSAPGTSESATPESGPGSEPATSGSETPGTSESATPESGPGSEPATSGSETPGTSESATPESGP |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | GTSTEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPESGP<br>GSEPATSGSETPGSEPATSGSETPGSPAGSPTSTEEGTSTEPSEGSAPGTSTEPSEGSAPGSEPAT<br>SGSETPGTSESATPESGPGTSTEPSEGSAP |
| AE144-<br>FVIII<br>BDD2-<br>FXIIa-<br>AE864 | GSEPATSGSETPGTSESATPESGPGSEPATSGSETPGSPAGSPTSTEEGTSTEPSEGSAPGSEPAT<br>SGSETPGSEPATSGSETPGSEPATSGSETPGTSTEPSEGSAPGTSESATPESGPGSEPATSGSETP<br>GTSTEPSEGSAPGATRRYYLGAVELSWDYMQSDLGELPVDARFPPRVPKSFPFNTSVVYKKT<br>LFVEFTVHLFNIAKPRPPWMGLLGPTIQAEVYDTVVITLKNMASHPVSLHAVGVSYWKASEG<br>AEYDDQTSQREKEDDKVFPGGSHTYVWQVLKENGPMASDPLCLTYSYLSHVDLVKDLNSGL<br>IGALLVCREGSLAKEKTQTLHKFILLFAVFDEGKSWHSETKNSLMQDRDAASARAWPKMHT<br>VNGYVNRSLPGLIGCHRKSVYWHVIGMGTTPEVHSIFLEGHTFLVRNHRQASLEISPITFLTAQ<br>TLLMDLGQFLLFCHISSHQHDGMEAYVKVDSCPEEPQLRMKNNEEAEDYDDDLTDSEMDVV<br>RFDDDNSPSFIQIRSVAKKHPKTWVHYIAAEEEDWDYAPLVLAPDDRSYKSQYLNNGPQRIG<br>RKYKKVRFMAYTDETFKTREAIQHESGILGPLLYGEVGDTLLIIFKNQASRPYNIYPHGITDVR<br>PLYSRRLPKGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQLEDPEFQAS<br>NIMHSINGYVFDSLQLSVCLHEVAYWYILSIGAQTDFLSVFFSGYTFKHKMVYEDTLTLFPFS<br>GETVFMSMENPGLWILGCHNSDFRNRGMTALLKVSSCDKNTGDYYEDSYEDISAYLLSKNN<br>AIEPRSFSQNPPVLKRHQREITRTTLQSDQEEIDYDDTISVEMKKEDFDIYDEDENQSPRSFQKK<br>TRHYFIAAVERLWDYGMSSSPHVLRNRAQSGSVPQFKKVVFQEFTDGSFTQPLYRGELNEHL<br>GLLGPYIRAEVEDNIMVTFRNQASRPYSFYSSLISYEEDQRQGAEPRKNFVKPNETKTYFWKV<br>QHHMAPTKDEFDCKAWAYFSDVDLEKDVHSGLIGPLLVCHTNTLNPAHGRQVTVQEFALFF<br>TIFDETKSWYFTENMERNCRAPCNIQMEDPTFKENYRFHAINGYIMDTLPGLVMAQDQRIRW<br>YLLSMGSNENIHSIHFSGHVFTVRKKEEYKMALYNLYPGVFETVEMLPSKAGIWRVECLIGEH<br>LHAGMSTLFLVYSNKCQTPLGMASGHIRDFQITASGQYGQWAPKLARLHYSGSINAWSTKEP<br>FSWIKVDLLAPMIIHGIKTQGARQKFSSLYISQFIIMYSLDGKKWQTYRGNSTGTLMVFFGNV<br>DSSGIKHNIFNPPIIARYIRLHPTHYSIRSTLRMELMGCDLNSCSMPLGMESKAISDAQITASSYF<br>TNMFATWSPSKARLHLQGRSNAWRPQVNNPKEWLQVDFQKTMKVTGVTTQGVKSLLTSM<br>YVKEFLISSSQDGHQWTLFFQNGKVKVFQGNQDSFTPVVNSLDPPLLTRYLRIHPQSWVHQIA<br>LRMEVLGCEAQDLYGTMTRIVGGGGSPAGSPTSTEEGTSESATPESGPGTSTEPSEGSAPGSPA<br>GSPTSTEEGTSTEPSEGSAPGTSTEPSEGSAPGTSESATPESGPGSEPATSGSETPGSEPATSGSE<br>TPGSPAGSPTSTEEGTSESATPESGPGTSTEPSEGSAPGTSTEPSEGSAPGSPAGSPTSTEEGTST<br>EPSEGSAPGTSTEPSEGSAPGTSESATPESGPGTSTEPSEGSAPGTSESATPESGPGSEPATSGSE<br>TPGTSTEPSEGSAPGTSTEPSEGSAPGTSESATPESGPGTSESATPESGPGSPAGSPTSTEEGTSES<br>ATPESGPGSEPATSGSETPGTSESATPESGPGTSTEPSEGSAPGTSTEPSEGSAPGTSTEPSEGSA<br>PGTSTEPSEGSAPGTSTEPSEGSAPGTSTEPSEGSAPGSPAGSPTSTEEGTSTEPSEGSAPGTSES<br>ATPESGPGSEPATSGSETPGTSESATPESGPGSEPATSGSETPGTSESATPESGPGTSTEPSEGSA<br>PGTSESATPESGPGSPAGSPTSTEEGSPAGSPTSTEEGSPAGSPTSTEEGTSESATPESGPGTSTEP<br>SEGSAPGTSESATPESGPGSEPATSGSETPGTSESATPESGPGSEPATSGSETPGTSESATPESGP<br>GTSTEPSEGSAPGSPAGSPTSTEEGTSESATPESGPGSEPATSGSETPGTSESATPESGPGSPAGS<br>PTSTEEGSPAGSPTSTEEGTSTEPSEGSAPGTSESATPESGPGTSESATPESGPGTSESATPESGP<br>GSEPATSGSETPGSEPATSGSETPGSPAGSPTSTEEGTSTEPSEGSAPGTSTEPSEGSAPGSEPAT<br>SGSETPGTSESATPESGPGTSTEPSEGSAP |
| AG144-<br>FVIII<br>BDD2-<br>FXIa-<br>AG576 | SGTASSSPGSSTPSGATGSPGTPGSGTASSSPGSSTPSGATGSPGSSPSASTGT<br>GPGSSPSASTGTGPGASPGTSSTGSPGTPGSGTASSSPGSSTPSGATGSPGSSPSASTGTGPGSSP<br>SASTGTGPGASPGATRRYYLGAVELSWDYMQSDLGELPVDARFPPRVPKSFPFNTSVVYKKT<br>LFVEFTVHLFNIAKPRPPWMGLLGPTIQAEVYDTVVITLKNMASHPVSLHAVGVSYWKASEG<br>AEYDDQTSQREKEDDKVFPGGSHTYVWQVLKENGPMASDPLCLTYSYLSHVDLVKDLNSGL<br>IGALLVCREGSLAKEKTQTLHKFILLFAVFDEGKSWHSETKNSLMQDRDAASARAWPKMHT<br>VNGYVNRSLPGLIGCHRKSVYWHVIGMGTTPEVHSIFLEGHTFLVRNHRQASLEISPITFLTAQ<br>TLLMDLGQFLLFCHISSHQHDGMEAYVKVDSCPEEPQLRMKNNEEAEDYDDDLTDSEMDVV<br>RFDDDNSPSFIQIRSVAKKHPKTWVHYIAAEEEDWDYAPLVLAPDDRSYKSQYLNNGPQRIG<br>RKYKKVRFMAYTDETFKTREAIQHESGILGPLLYGEVGDTLLIIFKNQASRPYNIYPHGITDVR<br>PLYSRRLPKGVKHLKDFPILPGEIFKYKWTVTVEDGPTKSDPRCLTRYYSSFVNMERDLASGL<br>IGPLLICYKESVDQRGNQIMSDKRNVILFSVFDENRSWYLTENIQRFLPNPAGVQLEDPEFQAS<br>NIMHSINGYVFDSLQLSVCLHEVAYWYILSIGAQTDFLSVFFSGYTFKHKMVYEDTLTLFPFS<br>GETVFMSMENPGLWILGCHNSDFRNRGMTALLKVSSCDKNTGDYYEDSYEDISAYLLSKNN<br>AIEPRSFSQNPPVLKRHQREITRTTLQSDQEEIDYDDTISVEMKKEDFDIYDEDENQSPRSFQKK<br>TRHYFIAAVERLWDYGMSSSPHVLRNRAQSGSVPQFKKVVFQEFTDGSFTQPLYRGELNEHL<br>GLLGPYIRAEVEDNIMVTFRNQASRPYSFYSSLISYEEDQRQGAEPRKNFVKPNETKTYFWKV<br>QHHMAPTKDEFDCKAWAYFSDVDLEKDVHSGLIGPLLVCHTNTLNPAHGRQVTVQEFALFF<br>TIFDETKSWYFTENMERNCRAPCNIQMEDPTFKENYRFHAINGYIMDTLPGLVMAQDQRIRW<br>YLLSMGSNENIHSIHFSGHVFTVRKKEEYKMALYNLYPGVFETVEMLPSKAGIWRVECLIGEH<br>LHAGMSTLFLVYSNKCQTPLGMASGHIRDFQITASGQYGQWAPKLARLHYSGSINAWSTKEP<br>FSWIKVDLLAPMIIHGIKTQGARQKFSSLYISQFIIMYSLDGKKWQTYRGNSTGTLMVFFGNV<br>DSSGIKHNIFNPPIIARYIRLHPTHYSIRSTLRMELMGCDLNSCSMPLGMESKAISDAQITASSYF<br>TNMFATWSPSKARLHLQGRSNAWRPQVNNPKEWLQVDFQKTMKVTGVTTQGVKSLLTSM<br>YVKEFLISSSQDGHQWTLFFQNGKVKVFQGNQDSFTPVVNSLDPPLLTRYLRIHPQSWVHQIA<br>LRMEVLGCEAQDLYGKLTRAETGPGTPGSGTASSSPGSSTPSGATGSPGSSPSASTGTGPGSSP<br>SASTGTGPGSSTPSGATGSPGSSTPSGATGSPGASPGTSSTGSPGASPGTSSTGSPGASPGTSSTG<br>SPGTPGSGTASSSPGASPGTSSTGSPGASPGTSSTGSPGASPGTSSTGSPGSSPSASTGTGPTPG<br>SGTASSSPGASPGTSSTGSPGASPGTSSTGSPGASPGTSSTGSPGSSTPSGATGSPGSSTPSGATG |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | SPGASPGTSSTGSPGTPGSGTASSSPGSSTPSGATGSPGSSTPSGATGSPGSSTPSGATGSPGSSP SASTGTGPGASPGTSSTGSPGASPGTSSTGSPGTPGSGTASSSPGASPGTSSTGSPGASPGTSSTG SPGASPGTSSTGSPGASPGTSSTGSPGTPGSGTASSSPGSSTPSGATGSPGTPGSGTASSSPGSST PSGATGSPGTPGSGTASSSPGSSTPSGATGSPGSSTPSGATGSPGSSPSASTGTGPGSSPSASTGT GPGASPGTSSTGSPGTPGSGTASSSPGSSTPSGATGSPGSSPSASTGTGPGSSPSASTGTGPGASP GTSSTGS |
| AE144-FXIa-FVIII BDD2-AE864 | GSEPATSGSETPGTSESATPESGPGSEPATSGSETPGSPAGSPTSTEEGTSTEPSEGSAPGSEPAT SGSETPGSEPATSGSETPGSEPATSGSETPGTSTEPSEGSAPGTSESATPESGPGSEPATSGSETP GTSTEPSEGSAPGKLTRAETGATRRYYLGAVELSWDYMQSDLGELPVDARFPPRVPKSFPFNT SVVYKKTLFVEFTDHLFNIAKPRPPWMGLLGPTIQAEVYDTVVITLKNMASHPVSLHAVGVS YWKASEGAEYDDQTSQREKEDDKVFPGGSHTYVWQVLKENGPMASDPLCLTYSYLSHVDL VKDLNSGLIGALLVCREGSLAKEKTQTLHKFILLFAVFDEGKSWHSETKNSLMQDRDAASAR AWPKMHTVNGYVNRSLPGLIGCHRKSVYWHVIGMGTTPEVHSIFLEGHTFLVRNHRQASLEI SPITFLTAQTLLMDLGQFLLFCHISSHQHDGMEAYVKVDSCPEEPQLRMKNNEEAEDYDDDL TDSEMDVVRFDDDNSPSFIQIRSVAKKHPKTWVHYIAAEEEDWDYAPLVLAPDDRSYKSQYL NNGPQRIGRKYKKVRFMAYTDETFKTREAIQHESGILGPLLYGEVGDTLLIIFKNQASRPYNIY PHGITDVRPLYSRRLPKGVKHLKDFPILPGEIFKYKWTVTVEDGPTKSDPRCLTRYYSSFVNM ERDLASGLIGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFKHKMVYED TLTLFPFSGETVFMSMENPGLWILGCHNSDFRNRGMTALLKVSSCDKNTGDYYEDSYEDISA YLLSKNNAIEPRSFSQNPPVLKRHQREITRTTLQSDQEEIDYDDTISVEMKKEDFDIYDEDENQ SPRSFQKKTRHYFIAAVERLWDYGMSSSPHVLRNRAQSGSVPQFKKVVFQEFTDGSFTQPLY RGELNEHLGLLGPYIRAEVEDNIMVTFRNQASRPYSFYSSLISYEEDQRQGAEPRKNFVKPNE TKTYFWKVQHHMAPTKDEFDCKAWAYFSDVDLEKDVHSGLIGPLLVCHTNTLNPAHGRQV TVQEFALFFTIFDETKSWYFTENMERNCRAPCNIQMEDPTFKENYRFHAINGYIMDTLPGLVM AQDQRIRWYLLSMGSNENIHSIHFSGHVFTVRKKEEYKMALYNLYPGVFETVEMLPSKAGIW RVECLIGEHLHAGMSTLFLVYSNKCQTPLGMASGHIRDFQITASGQYGQWAPKLARLHYSGS INAWSTKEPFSWIKVDLLAPMIIHGIKTQGARQKFSSLYISQFIIMYSLDGKKWQTYRGNSTGT LMVFFGNVDSSGIKHNIFNPPIIARYIRLHPTHYSIRSTLRMELMGCDLNSCSMPLGMESKAISD AQITASSYFTNMFATWSPSKARLHLQGRSNAWRPQVNNPKEWLQVDFQKTMKVTGVTTQG VKSLLTSMYVKEFLISSSQDGHQWTLFFQNGKVKVFQGNQDSFTPVVNSLDPPLLTRYLRIHP QSWVHQIALRMEVLGCEAQDLYGGSPAGSPTSTEEGTSESATPESGPGTSTEPSEGSAPGSPA GSPTSTEEGTSTEPSEGSAPGTSTEPSEGSAPGTSESATPESGPGSEPATSGSETPGSEPATSGSE TPGSPAGSPTSTEEGTSESATPESGPGTSTEPSEGSAPGTSTEPSEGSAPGSPAGSPTSTEEGTST EPSEGSAPGTSTEPSEGSAPGTSESATPESGPGTSTEPSEGSAPGSPAGSPTSTEEGSEPATSGSE TPGTSTEPSEGSAPGTSTEPSEGSAPGTSESATPESGPGTSESATPESGPGSPAGSPTSTEEGTSES /ATPESGPGSEPATSGSETPGTSESATPESGPGTSTEPSEGSAPGTSTEPSEGSAPGTSTEPSEGSA PGTSTEPSEGSAPGTSTEPSEGSAPGSPAGSPTSTEEGTSTEPSEGSAPGTSES ATPESGPGSEPATSGSETPGTSESATPESGPGSEPATSGSETPGTSESATPESGPGTSTEPSEGSA PGTSESATPESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSESATPESGP GSEPATSGSETPGSEPATSGSPAGSPTSTEEGTSTEPSEGSAPGTSTEPSEGSAPGSEPAT SGSETPGTSESATPESGPGTSTEPSEGSAP |
| AE144-FVIII BDD2-Y2332-Thrombin-AE864 | GSEPATSGSETPGTSESATPESGPGSEPATSGSETPGSPAGSPTSTEEGTSTEPSEGSAPGSEPAT SGSETPGSEPATSGSETPGSEPATSGSETPGTSTEPSEGSAPGTSESATPESGPGSEPATSGSETP GTSTEPSEGSAPGATRRYYLGAVELSWDYMQSDLGELPVDARFPPRVPKSFPFNTSVVYKKT LFVEFTVHLFNIAKPRPPWMGLLGPTIQAEVYDTVVITLKNMASHPVSLHAVGVSYWKASEG AEYDDQTSQREKEDDKVFPGGSHTYVWQVLKENGPMASDPLCLTYSYLSHVDLNSGL IGALLVCREGSLAKEKTQTLHKFILLFAVFDEGKSWHSETKNSLMQDRDAASARAWPKMHT VNGYVNRSLPGLIGCHRKSVYWHVIGMGTTPEVHSIFLEGHTFLVRNHRQASLEISPITFLTAQ TLLMDLGQFLLFCHISSHQHDGMEAYVKVDSCPEEPQLRMKNNEEAEDYDDDLTDSEMDVV RFDDDNSPSFIQIRSVAKKHPKTWVHYIAAEEEDWDYAPLVLAPDDRSYKSQYLNNGPQRIG RKYKKVRFMAYTDETFKTREAIQHESGILGPLLYGEVGDTLLIIFKNQASRPYNIYPHGITDVR PLYSRRLPKGVKHLKDFPILPGEIFKYKWTVTVEDGPTKSDPRCLTRYYSSFVNMERDLASGL IGPLLICYKESVDQRGNQIMSDKRNVILFSVFDENRSWYLTENIQRFLPNPAGVQLEDPEFQAS NIMHSINGYVFDSLQLSVCLHEVAYWYILSIGAQTDFLSVFFSGYTFKHKMVYEDTLTLFPFS GETVFMSMENPGLWILGCHNSDFRNRGMTALLKVSSCDKNTGDYYEDSYEDISAYLLSKNN AIEPRSFSQNPPVLKRHQREITRTTLQSDQEEIDYDDTISVEMKKEDFDIYDEDENQSPRSFQKK TRHYFIAAVERLWDYGMSSSPHVLRNRAQSGSVPQFKKVVFQEFTDGSFTQPLYRGELNEHL GLLGPYIRAEVEDNIMVTFRNQASRPYSFYSSLISYEEDQRQGAEPRKNFVKPNETKTYFWKV QHHMAPTKDEFDCKAWAYFSDVDLEKDVHSGLIGPLLVCHTNTLNPAHGRQVTVQEFALFF TIFDETKSWYFTENMERNCRAPCNIQMEDPTFKENYRFHAINGYIMDTLPGLVMAQDQRIRW YLLSMGSNENIHSIHFSGHVFTVRKKEEYKMALYNLYPGVFETVEMLPSKAGIWRVECLIGEH LHAGMSTLFLVYSNKCQTPLGMASGHIRDFQITASGQYGQWAPKLARLHYSGSINAWSTKEP FSWIKVDLLAPMIIHGIKTQGARQKFSSLYISQFIIMYSLDGKKWQTYRGNSTGTLMVFFGNV DSSGIKHNIFNPPIIARYIRLHPTHYSIRSTLRMELMGCDLNSCSMPLGMESKAISDAQITASSYF TNMFATWSPSKARLHLQGRSNAWRPQVNNPKEWLQVDFQKTMKVTGVTTQGVKSLLTSM YVKEFLISSSQDGHQWTLFFQNGKVKVFQGNQDSFTPVVNSLDPPLLTRYLRIHPQSWVHQIA LRMEVLGCEAQDLYGLTPRSLLVGGSPAGSPTSTEEGTSESATPESGPGTSTEPSEGSAPGSPA GSPTSTEEGTSTEPSEGSAPGTSTEPSEGSAPGTSESATPESGPGSEPATSGSETPGSEPATSGSE |

353 354

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | TPGSPAGSPTSTEEGTSESATPESGPGTSTEPSEGSAPGTSTEPSEGSAPGSPAGSPTSTEEGTST EPSEGSAPGTSTEPSEGSAPGTSESATPESGPGTSTEPSEGSAPGTSESGPGSEPATSGSE TPGTSTEPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEPSEGSA PGTSTEPSEGSAPGTSTEPSEGSAPGTSTEPSEGSAPGSPAGSPTSTEEGTSTEPSEGSAPGTSESS ATPESGPGSEPATSGSETPGTSESATPESGPGSEPATSGSETPGTSESATPESGPGTSTEPSEGSA PGTSESATPESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEPAT SGSETPGTSESATPESGPGTSTEPSEGSAP |
| AE864-<br>FVIII-<br>MMP-17-<br>AE144 | GSPAGSPTSTEEGTSESATPESGPGTSTEPSEGSAPGSPAGSPTSTEEGTSTEPSEGSAPGTSTEPS EGSAPGTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGSAPGTSTEPSEGSAPGT SESATPESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPGSEPATSGSE TPGTSESATPESGPGSEPATSGSETPGTSESATPESGPGSPAGSPTSTEEGTSES ATPESGPGSEPATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPATSGSETPGSPAG SPTSTEEGTSTEPSEGSAPGTSTEPSEGSAPGSEPATSGSETPGTSESATPESGPGTSTEPSEGSAP GATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQRE KEDDKVFPGGSHTYVWQVLKENGPMASDPLCLTYSYLSHVDLVKDLNSGLIGALLVCREGS LAKEKTQTLHKFILLFAVFDEGKSWHSETKNSLMQDRDAASARAWPKMHTVNGYVNRSLPG LIGCHRKSVYWHVIGMGTTPEVHSIFLEGHTFLVRNHRQASLEISPITFLTAQTLLMDLGQFLL FCHISSSHQHDGMEAYVKVDSCPEEPQLRMKNNEEAEDYDDDLTDSEMDVVRFDDDNSPSFIQ IRSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSMENPG LWILGCHNSDFRNRGMTALLKVSSCDKNTGDYYEDSYEDISAYLLSKNNAIEPRSFSQNSRHP STRQKQFNATTIPENDIEKTDPWFAHRTPMPKIQNVSSSDLLMLLRQSPTPHGLSLSDLQEAKY ETFSDDPSPGAIDSNNSLSEMTHFRPQLHHSGDMVFTPESGLQLRLNEKLGTTAATELKKLDF KVSSTSNNLISTIPSDNLAAGTDNTSSLGPPSMPVHYDSQLDTTLFGKKSSPLTESGGPLSLSEE NNDSKLLESGLMNSQESSWGKNVSSTESGRLFKGKRAHGPALLTKDNALFKVSISLLKTNKT SNNSATNRKTHIDGPSLLIENSPSVWQNILESDTEFKKVTPLIHDRMLMDKNATALRLNHMSN KTTSSKNMEMVQQKKEGPIPPDAQNPDMSFFKMLFLPESARWIQRTHGKNSLNSGQGPSPKQ LVSLGPEKSVEGQNFLSEKNKVVVGKGEFTKDVGLKEMVFPSSRNLFLTNLDNLHENNTHNQ EKKIQEEIEKKETLIQENVVLPQIHTVTGTKNFMKNLFLLSTRQNVEGSYDGAYAPVLQDFRS LNDSTNRTKKHTAHFSKKGEEENLEGLGNQTKQIVEKYACTTRISPNTSQQNFVTQRSKRAL KQFRLPLEETELEKRIIVDDTSTQWSKNMKHLTPSTLTQIDYNEKEKGAITQSPLSDCLTRSHSI PQANRSPLPIAKVSSFPSIRPIYLTRVLFQDNSSHLPAASYRKKDSGVQESSHFLQGAKKNNLS LAILTLEMTGDQREVGSLGTSATNSVTYKKVENTVLPKPDLPKTSGKVELLPKVHIYQKDLFP TETSNGSPGHLDLVEGSLLQGTEGAIKWNEANRPGKVPFLRVATESSSAKTPSKLLDPLAWDN HYGTQIPKEEWKSQEKSPEKTAFKKKDTILSLNACESNHAIAAINEGQNKPEIEVTWAKQGRT ERLCSQNPPVLKRHQREITRTTLQSDQEEIDYDDTISVEMKKEDFDIYDEDENQSPRSFQKKTR HYFIAAVERLWDYGMSSSPHVLRNRAQSGSVPQFKKVVFQEFTDGSFTQPLYRGELNEHLGL LGPYIRAEVEDNIMVTFRNQASRPYSFYSSLISYEEDQRQGAEPRKNFVKPNETKTYFWKVQH HMAPTKDEFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQDQRIRWYL LSMGSNENIHSIHFSGHVFTVRKKEEYKMALYNLYPGVFETVEMLPSKAGIWRVECLIGEHLH AGMSTLFLVYSNKCQTPLGMASGHIRDFQITASGQYGQWAPKLARLHYSGSINAWSTKEPFS WIKVDLLAPMIIHGIKTQGARQKFSSLYISQFIIMYSLDGKKWQTYRGNSTGTLMVFFGNVDS SGIKHNIFNPPIIARYIRLHPTHYSIRSTLRMELMGCDLNSCSMPLGMESKAISDAQITASSYFTN MFATWSPSKARLHLQGRSNAWRPQVNNPKEWLQVDFQKTMKVTGVTTQGVKSLLTSMYV KEFLISSSQDGHQWTLFFQNGKVKVFQGNQDSFTPVVNSLDPPLLTRYLRIHPQSWVHQIALR MEVLGCEAQDLYGAPLGLRLRGGSEPATSGSETPGTSESATPESGPGSEPATSGSETPGSPAGS PTSTEEGTSTEPSEGSAPGSEPATSGSETPGSEPATSGSETPGSEPATSGSETPGTSTEPSEGSAP GTSESATPESGPGSEPATSGSETPGTSTEPSEGSAP |
| AF144-<br>FXIIa-<br>FVIII-<br>FXIIa-<br>AF864 | GTSTPESGSASPGTSPSGESSTAPGTSPSGESSTAPGTSSSTAESPGPGSTSESPSGTAPGSTSSTA ESPGPGTSPSGESSTAPGTSTPESGSASPGTSSSTAESPGPGTSPSGESSTAPGTSPSGESSTAPGT SPSGESSTAPGTMTRIVGGATRRYYLGAVELSWDYMQSDLGELPVDARFPPRVPKSFPFNTSV VYKKTLFVEFTDHLFNIAKPRPPWMGLLGPTIQAEVYDTVVITLKNMASHPVSLHAVGVSYW KASEGAEYDDQTSQREKEDDKVFPGGSHTYVWQVLKENGPMASDPLCLTYSYLSHVDLVK DLNSGLIGALLVCREGSLAKEKTQTLHKFILLFAVFDEGKSWHSETKNSLMQDRDAASARAW |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | PKMHTVNGYVNRSLPGLIGCHRKSVYWHVIGMGTTPEVHSIFLEGHTFLVRNHRQASLEISPI TFLTAQTLLMDLGQFLLFCHISSSHQHDGMEAYVKVDSCPEEPQLRMKNNEEAEDYDDDLTD SEMDVVRFDDDNSPSFIQIRSVAKKHPKTWVHYIAAEEEDWDYAPLVLAPDDRSYKSQYLNN GPQRIGRKYKKVRFMAYTDETFKTREAIQHESGILGPLLYGEVGDTLLIIFKNQASRPYNIYPH GITDVRPLYSRRLPKGVKHLKDFPILPGEIFKYKWTVTVEDGPTKSDPRCLTRYYSSFVNMER DLASGLIGPLLICYKESVDQRGNQIMSDKRNVILFSVFDENRSWYLTENIQRFLPNPAGVQLED PEFQASNIMHSINGYVFDSLQLSVCLHEVAYWYILSIGAQTDFLSVFFSGYTFKHKMVYEDTL TLFPPFSGETVFMSMENPGLWILGCHNSDFRNRGMTALLKVSSCDKNTGDYYEDSYEDISAYL LSKNNAIEPRSFSQNSRHPSTRQKQFNATTIPENDIEKTDPWFAHRTPMPKIQNVSSSDLLMLL RQSPTPHGLSLSDLQEAKYETFSDDPSPGAIDSNNSLSEMTHFRPQLHHSGDMVFTPESGLQLR LNEKLGTTAATELKKLDFKVSSTSNNLISTIPSDNLAAGTDNTSSLGPPSMPVHYDSQLDTTLF GKKSSPLTESGGPLSLSEENNDSKLLESGLMNSQESSWGKNVSSTESGRLFKGKRAHGPALLT KDNALFKVSISLLKTNKTSNNSATNRKTHIDGPSLLIENSPSVWQNILESDTEFKKVTPLIHDR MLMDKNATALRLNHMSNKTTSSKNMEMVQQKKEGPIPPDAQNPDMSFFKMLFLPESARWIQ RTHGKNSLNSGQGPSPKQLVSLGPEKSVEGQNFLSEKNKVVVGKGEFTKDVGLKEMVFPSSR NLFLTNLDNLHENNTHNQEKKIQEEIEKKETLIQENVVLPQIHTVTGTKNFMKNLFLLSTRQN VEGSYDGAYAPVLQDFRSLNDSTNRTKKHTAHFSKKGEEENLEGLGNQTKQIVEKYACTTRI SPNTSQQNFVTQRSKRALKQFRLPLEETELEKRIIVDDTSTQWSKNMKHLTPSTLTQIDYNEKE KGAITQSPLSDCLTRSHSIPQANRSPLPIAKVSSFPSIRPIYLTRVLFQDNSSHLPAASYRKKDSG VQESSHFLQGAKKNNLSLAILTLEMTGDQREVGSLGTSATNSVTYKKVENTVLPKPDLPKTS GKVELLPKVHIYQKDLFPTETSNGSPGHLDLVEGSLLQGTEGAIKWNEANRPGKVPFLRVATE SSAKTPSKLLDPLAWDNHYGTQIPKEEWKSQEKSPEKTAFKKKDTILSLNACESNHAIAAINE GQNKPEIEVTWAKQGRTERLCSQNPPVLKRHQREITRTTLQSDQEEIDYDDTISVEMKKEDFD IYDEDENQSPRSFQKKTRHYFIAAVERLWDYGMSSSPHVLRNRAQSGSVPQFKKVVFQEFTD GSFTQPLYRGELNEHLGLLGPYIRAEVEDNIMVTFRNQASRPYSFYSSLISYEEDQRQGAEPRK NFVKPNETKTYFWKVQHHMAPTKDEFDCKAWAYFSDVDLEKDVHSGLIGPLLVCHTNTLNP AHGRQVTVQEFALFFTIFDETKSWYFTENMERNCRAPCNIQMEDPTFKENYRFHAINGYIMD TLPGLVMAQDQRIRWYLLSMGSNENIHSIHFSGHVFTVRKKEEYKMALYNLYPGVFETVEML PSKAGIWRVECLIGEHLHAGMSTLFLVYSNKCQTPLGMASGHIRDFQITASGQYGQWAPKLA RLHYSGSINAWSTKEPFSWIKVDLLAPMIIHGIKTQGARQKFSSLYISQFIIMYSLDGKKWQTY RGNSTGTLMVFFGNVDSSGIKHNIFNPPIIARYIRLHPTHYSIRSTLRMELMGCDLNSCSMPLG MESKAISDAQITASSYFTNMFATWSPSKARLHLQGRSNAWRPQVNNPKEWLQVDFQKTMKV TGVTTQGVKSLLTSMYVKEFLISSSQDGHQWTLFFQNGKVKVFQGNQDSFTPVVNSLDPPLL TRYLRIHPQSWVHQIALRMEVLGCEAQDLYGTMTRIVGGGSTSESPSGTAPGTSPSGESSTAP GSTSESPSGTAPGSTSESPSGTAPGTSTPESGSASPGTSTPESGSASPGSTSESPSGTAPGSTSESP SGTAPGTSPSGESSTAPGSTSESPSGTAPGTSPSGESSTAPGSTSSTAESPGPGT SPSGESSTAPGTSPSGESSTAPGTSSTAESPGPGTSTPESGSASPGTSTPESGSASPGSTSESPSG TAPGSTSESPSGTAPGTSTPESGSASPGTSSTAESPGPGTSTPESGSASPGSTSESPSGTAPGTSP SGESSTAPGSTSSTAESPGPGTSPSGESSTAPGTSTPESGSASPGSTSSTAESPGPGSTSSTAESPG PGSTSSTAESPGPGSTSSTAESPGPGTSPSGESSTAPGSTSESPSGTAPGSTSESPSGTAPGTSTPE SGPXXXGASASGAPSTX)OO(SESPSGTAPGSTSESPSGTAPGSTSESPSGTAPGSTSESPSGTAP GSTSESPSGTAPGSTSESPSGTAPGTSTPESGSASPGTSPSGESSTAPGTSPSGESSTAPGSTSSTA ESPGPGTSPSGESSTAPGTSTPESGSASPGSTSESPSGTAPGSTSESPSGTAPGTSPSGESSTAPGS TSESPSGTAPGTSTPESGSASPGTSTPESGSASPGSTSSTAES PGPGSTSESPSGTAPGSTSESPSGTAPGTSPSGESSTAPGSTSSTAESPGPGTSPSGESSTAPGTST PESGSASPGTSPSGESSTAPGTSPSGESSTAPGTSPSGESSTAPGSTSSTAESPGPGSTSSTAESPG PGTSPSGESSTAPGSSPSASTGTGPGSSTPSGATGPGSSTPSGATGSP |
| AE864-FVIII-FXIa-AE144 | GSPAGSPTSTEEGTSESATPESGPGTSTEPSEGSAPGSPAGSPTSTEEGTSTEPSEGSAPGTSTEPS EGSAPGTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGSAPGT SESATPESGPGTSESATPESGPGSPAGSPTSTEEGTSTEPSEGSAPGSPAGSPTSTEEGTSESATPE SGPGTSTEPSEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPGSEPATSGSE TPGTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPATSGSETPGSPAG SPTSTEEGTSTEPSEGSAPGTSTEPSEGSAPGSEPATSGSETPESGPGTSTEPSEGSAP GATRRYYLGAVELSWDYMQSDLGELPVDARFPPRVPKSFPFNTSVVYKKTLFVEFTDHLFNI AKPRPPWMGLLGPTIQAEVYDTVVITLKNMASHPVSLHAVGVSYWKASEGAEYDDQTSQRE KEDDKVFPGGSHTYVWQVLKENGPMASDPLCLTYSYLSHVDLVKDLNSGLIGALLVCREGS LAKEKTQTLHKFILLFAVFDEGKSWHSETKNSLMQDRDAASARAWPKMHTVNGYVNRSLPG LIGCHRKSVYWHVIGMGTTPEVHSIFLEGHTFLVRNHRQASLEISPITFLTAQTLLMDLGQFLL FCHISSSHQHDGMEAYVKVDSCPEEPQLRMKNNEEAEDYDDDLTDSEMDVVRFDDDNSPSFIQ IRSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPPFSGETVFMSMENPG LWILGCHNSDFRNRGMTALLKVSSCDKNTGDYYEDSYEDISAYLLSKNNAIEPRSFSQNSRHP STRQKQFNATTIPENDIEKTDPWFAHRTPMPKIQNVSSSDLLMLLRQSPTPHGLSLSDLQEAKY |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | ETFSDDPSPGAIDSNNSLSEMTHFRPQLHHSGDMVFTPESGLQLRLNEKLGTTAATELKKLDF KVSSTSNNLISTIPSDNLAAGTDNTSSLGPPSMPVHYDSQLDTTLFGKVSSP LTESGGPLSLSEE NNDSKLLESGLMNSQESSWGKNVSSTESGRLFKGKRAHGPALLTKDNALFKVSISLLKTNKT SNNSATNRKTHIDGPSLLIENSPSVWQNILESDTEFKKVTPLIHDRMLMDKNATALRLNHMSN KTTSSKNMEMVQQKKEGPIPPDAQNPDMSFFKMLFLPESARWIQRTHGKNSLNSGQGPSPKQ LVSLGPEKSVEGQNFLSEKNKVVVGKGEFTKDVGLKEMVFPSSRNLFLTNLDNLHENNTHNQ EKKIQEEIEKKETLIQENVVLPQIHTVTGTKNFMKNLFLLSTRQNVEGSYDGAYAPVLQDFRS LNDSTNRTKKHTAHFSKKGEEENLEGLGNQTKQIVEKYACTTRISPNTSQQNFVTQRSKRAL KQFRLPLEETELEKRIIVDDTSTQWSKNMKHLTPSTLTQIDYNEKEKGAITQSPLSDCLTRSHSI PQANRSPLPIAKVSSFPSIRPIYLTRVLFQDNSSHLPAASYRKKDSGVQESSHFLQGAKKNNLS LAILTLEMTGDQREVGSLGTSATNSVTYKKVENTVLPKPDLPKTSGKVELLPKVHIYQKDLFP TETSNGSPGHLDLVEGSLLQGTEGAIKWNEANRPGKVPFLRVATESSAKTPSKLLDPLAWDN HYGTQIPKEEWKSQEKSPEKTAFKKKDTILSLNACESNHAIAAINEGQNKPEIEVTWAKQGRT ERLCSQNPPVLKRHQREITRTTLQSDQEEIDYDDTISVEMKKEDFDIYDEDENQSPRSFQKKTR HYFIAAVERLWDYGMSSSPHVLRNRAQSGSVPQFKKVVFQEFTDGSFTQPLYRGELNEHLGL LGPYIRAEVEDNIMVTFRNQASRPYSFYSSLISYEEDQRQGAEPRKNFVKPNETKTYFWKVQH HMAPTKDEFDCKAWAYFSDVDLEKDVHSGLIGPLLVCHTNTLNPAHGRQVTVQEFALFFTIF DETKSWYFTENMERNCRAPCNIQMEDPTFKENYRFHAINGYIMDTLPGLVMAQDQRIRWYL LSMGSNENIHSIHFSGHVFTVRKKEEYKMALYNLYPGVFETVEMLPSKAGIWRVECLIGEHLH AGMSTLFLVYSNKCQTPLGMASGHIRDFQITASGQYGQWAPKLARLHYSGSINAWSTKEPFS WIKVDLLAPMIIHGIKTQGARQKFSSLYISQFIIMYSLDGKKWQTYRGNSTGTLMVFFGNVDS SGIKHNIFNPPIIARYIRLHPTHYSIRSTLRMELMGCDLNSCSMPLGMESKAISDAQITASSYFTN MFATWSPSKARLHLQGRSNAWRPQVNNPKEWLQVDFQKTMKVTGVTTQGVKSLLTSMYV KEFLISSSQDGHQWTLFFQNGKVKVFQGNQDSFTPVVNSLDPPLLTRYLRIHPQSWVHQIALR MEVLGCEAQDLYGKLTRAETGGSEPATSGSETPGTSESATPESGPGSEPATSGSETPGSPAGSP TSTEEGTSTEPSEGSAPGSEPATSGSETPGSEPATSGSETPGSEPATSGSETPGTSTEPSEGSAPG TSESATPESGPGSEPATSGSETPGTSTEPSEGSAP |
| AE144-FXIa-FVIII BDD9-AE864 | GSEPATSGSETPGTSESATPESGPGSEPATSGSETPGSPAGSPTSTEEGTSTEPSEGSAPGSEPAT SGSETPGSEPATSGSETPGSEPATSGSETPGTSTEPSEGSAPGTSESATPESGPGSEPATSGSETP GTSTEPSEGSAPGKLTRAETGATRRYYLGAVELSWDYMQSDLGELPVDARFPPRVPKSFPFNT SVVYKKTLFVEFTDHLFNIAKPRPPWMGLLGPTIQAEVYDTVVITLKNMASPVSLHAVGVS YWKASEGAEYDDQTSQREKEDDKVFPGGSHTYVWQVLKENGPMASDPLCLTYSYLSHVDL VKDLNSGLIGALLVCREGSLAKEKTQTLHKFILLFAVFDEGKSWHSETKNSLMQDRDAASAR AWPKMHTVNGYVNRSLPGLIGCHRKSVYWHVIGMGTTPEVHSIFLEGHTFLVRNHRQASLEI SPITFLTAQTLLMDLGQFLLFCHISSSHQHDGMEAYVKVDSCPEEPQLRMKNNEEAEDYDDDL TDSEMDVVRFDDDNSPSFIQIRSVAKKHPKTWVHYIAAEEEDWDYAPLVLAPDDRSYKSQYL NNGPQRIGRKYKKVRFMAYTDETFKTREAIQHESGILGPLLYGEVGDTLLIIFKNQASRPYNIY PHGITDVRPLYSRRLPKGVKHLKDFPILPGEIFKYKWTVTVEDGPTKSDPRCLTRYYSSFVNM ERDLASGLIGPLLICYKESVDQRGNQIMSDKRNVILFSVFDENRSWYLTENIQRFLPNPAGVQL EDPEFQASNIMHSINGYVFDSLQLSVCLHEVAYWYILSIGAQTDFLSVFFSGYTFKHKMVYED TLTLFPFSGETVFMSMENPGLWILGCHNSDFRNRGMTALLKVSSCDKNTGDYYEDSYEDISA YLLSKNNAIEPRSFSQNPPVLKRHQREITRTTLQSDQEEIDYDDTISVEMKKEDFDIYDEDENQ SPRSFQKKTRHYFIAAVERLWDYGMSSSPHVLRNRAQSGSVPQFKKVVFQEFTDGSFTQPLY RGELNEHLGLLGPYIRAEVEDNIMVTFRNQASRPYSFYSSLISYEEDQRQGAEPRKNFVKPNE TKTYFWKVQHHMAPTKDEFDCKAWAYFSDVDLEKDVHSGLIGPLLVCHTNTLNPAHGRQV TVQEFALFFTIFDETKSWYFTENMERNCRAPCNIQMEDPTFKENYRFHAINGYIMDTLPGLVM AQDQRIRWYLLSMGSNENIHSIHFSGHVFTVRKKEEYKMALYNLYPGVFETVEMLPSKAGIW RVECLIGEHLHAGMSTLFLVYSNKCQTPLGMASGHIRDFQITASGQYGQWAPKLARLHYSGS INAWSTKEPFSWIKVDLLAPMIIHGIKTQGARQKFSSLYISQFIIMYSLDGKKWQTYRGNSTGT LMVFFGNVDSSGIKHNIFNPPIIARYIRLHPTHYSIRSTLRMELMGCDLNSCSMPLGMESKAISD AQITASSYFTNMFATWSPSKARLHLQGRSNAWRPQVNNPKEWLQVDFQKTMKVTGVTTQG VKSLLTSMYVKEFLISSSQDGHQWTLFFQNGKVKVFQGNQDSFTPVVNSLDPPLLTRYLRIHP QSWVHQIALRMEVLGCEAQDLYGGSPAGSPTSTEEGTSESATPESGPGTSTEPSEGSAPGSPA GSPTSTEEGTSTEPSEGSAPGTSTEPSEGSAPGTSESATPESGPGSEPATSGSETPGSEPATSGSE TPGSPAGSPTSTEEGTSESATPESGPGTSTEPSEGSAPGTSTEPSEGSAPGSPAGSPTSTEEGTST EPSEGSAPGTSTEPSEGSAPGTSESATPESGPGTSTEPSEGSAPGTSTEPSEGSAPGSPAGSPTSTEEGTSESATPESGPGSEPATSGSETPGTSESATPESGPGTSTEPSEGSAPGTSTEPSEGSAPGTSESATPESGPGTSESATPESGPGSPAGSPTSTEEGTSESATPESGPGTSTEPSEGSAPGTSTEPSEGSA PGTSTEPSEGSAPGTSTEPSEGSAPGSPAGSPTSTEEGTSTEPSEGSAPGTSES ATPESGPGSEPATSGSETPGTSESATPESGPGSEPATSGSETPGTSESATPESGPGTSESA PGTSESATPESGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPGSEPAT SGSETPGTSESATPESGPGTSTEPSEGSAP |
| AE48-FXIa-FVIII BDD9-AE864 | MAEPAGSPTSTEEGTPGSGTASSSPGSSTPSGATGSPGASPGTSSTGSPGKLTRAETGATRRYY LGAVELSWDYMQSDLGELPVDARFPPRVPKSFPFNTSVVYKKTLFVEFTDHLFNIAKPRPPW MGLLGPTIQAEVYDTVVITLKNMASHPVSLHAVGVSYWKASEGAEYDDQTSQREKEDDKVF PGGSHTYVWQVLKENGPMASDPLCLTYSYLSHVDLVKDLNSGLIGALLVCREGSLAKEKTQ TLHKFILLFAVFDEGKSWHSETKNSLMQDRDAASARAWPKMHTVNGYVNRSLPGLIGCHRK SVYWHVIGMGTTPEVHSIFLEGHTFLVRNHRQASLEISPITFLTAQTLLMDLGQFLLFCHISSH |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | QHDGMEAYVKVDSCPEEPQLRMKNNEEAEDYDDDLTDSEMDVVRFDDDNSPSFIQIRSVAK KHPKTWVHYIAAEEEDWDYAPLVLAPDDRSYKSQYLNNGPQRIGRKYKKVRFMAYTDETF KTREAIQHESGILGPLLYGEVGDTLLIIFKNQASRPYNIYPHGITDVRPLYSRRLPKGVKHLKDF PILPGEIFKYKWTVTVEDGPTKSDPRCLTRYYSSFVNMERDLASGLIGPLLICYKESVDQRGNQ IMSDKRNVILFSVFDENRSWYLTENIQRFLPNPAGVQLEDPEFQASNIMHSINGYVFDSLQLSV CLHEVAYWYILSIGAQTDFLSVFFSGYTFKHKMVYEDTLTLFPFSGETVFMSMENPGLWILGC HNSDFRNRGMTALLKVSSCDKNTGDYYEDSYEDISAYLLSKNNAIEPRSFSQNPPVLKRHQRE ITRTTLQSDQEEIDYDDTISVEMKKEDFDIYDEDENQSPRSFQKKTRHYFIAAVERLWDYGMS SSPHVLRNRAQSGSVPQFKKVVFQEFTDGSFTQPLYRGELNEHLGLLGPYIRAEVEDNIMVTF RNQASRPYSFYSSLISYEEDQRQGAEPRKNFVKPNETKTYFWKVQHHMAPTKDEFDCKAWA YFSDVDLEKDVHSGLIGPLLVCHTNTLNPAHGRQVTVQEFALFFTIFDETKSWYFTENMERNC RAPCNIQMEDPTFKENYRFHAINGYIMDTLPGLVMAQDQRIRWYLLSMGSNENIHSIHFSGHV FTVRKKEEYKMALYNLYPGVFETVEMLPSKAGIWRVECLIGEHLHAGMSTLFLVYSNKCQTP LGMASGHIRDFQITASGQYGQWAPKLARLHYSGSINAWSTKEPFSWIKVDLLAPMIIHGIKTQ GARQKFSSLYISQFIIMYSLDGKKWQTYRGNSTGTLMVFFGNVDSSGIKHNIFNPPIIARYIRLH PTHYSIRSTLRMELMGCDLNSCSMPLGMESKAISDAQITASSYFTNMFATWSPSKARLHLQGR SNAWRPQVNNPKEWLQVDFQKTMKVTGVTTQGVKSLLTSMYVKEFLISSSQDGHQWTLFFQ NGKVKVFQGNQDSFTPVVNSLDPPLLTRYLRIHPQSWVHQIALRMEVLGCEAQDLYGGSPAG SPTSTEEGTSESATPESGPGTSTEPSEGSAPGSPAGSPTSTEEGTSESATPESGPGTSTEPSEGSAP GTSESATPESGPGSEPATSGSETPGSEPATSGSETPGSPAGSPTSTEEGTSESATPESGPGTSTEPS EGSAPGTSTEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSAPGTSESATP ESGPGTSESATPESGPGSPAGSPTSTEEGTSESATPESGPGSEPATSGSETPGTSESATPESGPGT STEPSEGSAPGTSTEPSEGSAPGTSTEPSEGSAPGTSTEPSEGSAPGTSTEPSEGSAPGTSTEPSEG SAPGSPAGSPTSTEEGTSTEPSEGSAPGTSESATPESGPGSEPATSGSETPGTSESATPESGPGSE PATSGSETPGTSESATPESGPGTSTEPSEGSAPGTSESATPESGPGSPAGSPTSTEEGSPAGSPTS TEEGSPAGSPTSTEEGTSESATPESGPGTSTEPSEGSAPGTSESATPESGPGSEPATSGSETPGTS ESATPESGPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGSAPGTSE SATPESGPGTSESATPESGPGTSESATPESGPGSEPATSGSETPGSEPATSGSETPGSPAGSPTST EEGTSTEPSEGSAPGTSTEPSEGSAPGSEPATSGSETPGTSESATPESGPGTSTEPSEGSAP |
| FVIII BDD9- FXIa- AG288_2 | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSMENPG LWILGCHNSDFRNRGMTALLKVSSCDKNTGDYYEDSYEDISAYLLSKNNAIEPRSFSQNPPVL KRHQREITRTTLQSDQEEIDYDDTISVEMKKEDFDIYDEDENQSPRSFQKKTRHYFIAAVERL WDYGMSSSPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHHMAPTKDEF DCKAWAYFSDVDLEKDVHSGLIGPLLVCHTNTLNPAHGRQVTVQEFALFFTIFDETKSWYFT ENMERNCRAPCNIQMEDPTFKENYRFHAINGYIMDTLPGLVMAQDQRIRWYLLSMGSNENIH SIHFSGHVFTVRKKEEYKMALYNLYPGVFETVEMLPSKAGIWRVECLIGEHLHAGMSTLFLV YSNKCQTPLGMASGHIRDFQITASGQYGQWAPKLARLHYSGSINAWSTKEPFSWIKVDLLAP MIIHGIKTQGARQKFSSLYISQFIIMYSLDGKKWQTYRGNSTGTLMVFFGNVDSSGIKHNIFNP PIIARYIRLHPTHYSIRSTLRMELMGCDLNSCSMPLGMESKAISDAQITASSYFTNMFATWSPS KARLHLQGRSNAWRPQVNNPKEWLQVDFQKTMKVTGVTTQGVKSLLTSMYVKEFLISSSQD GHQWTLFFQNGKVKVFQGNQDSFTPVVNSLDPPLLTRYLRIHPQSWVHQIALRMEVLGCEA QDLYKLTRAETGPGASPGTSSTGSPGASPGTSSTGSPGTPGSGTASSSPGSSTPSGATGSPGTPG SGTASSSPGSSTPSGATGSPGTPGSGTASSSPGSSTPSGATGSPGSSPSASTGT GPGSSPSASTGTGPGASPGTSSTGSPGTPGSGTASSSPGSSTPSGATGSPGSSPSASTGTGPGSSP SASTGTGPGASPGTSSTGSPGASPGTSSTGSPGSSTPSGATGSPGSSPSASTGTGPGASPGTSSTG SPGSSPSASTGTGPGTPGSGTASSSPGSSTPSGATGS |
| FVIII BDD9- FXIa- AG864 | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSMENPG LWILGCHNSDFRNRGMTALLKVSSCDKNTGDYYEDSYEDISAYLLSKNNAIEPRSFSQNPPVL KRHQREITRTTLQSDQEEIDYDDTISVEMKKEDFDIYDEDENQSPRSFQKKTRHYFIAAVERL |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | WDYGMSSSPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHHMAPTKDEF DCKAWAYFSDVDLEKDVHSGLIGPLLVCHTNTLNPAHGRQVTVQEFALFFTIFDETKSWYFT ENMERNCRAPCNIQMEDPTFKENYRFHAINGYIMDTLPGLVMAQDQRIRWYLLSMGSNENIH SIHFSGHVFTVRKKEEYKMALYNLYPGVFETVEMLPSKAGIWRVECLIGEHLHAGMSTLFLV YSNKCQTPLGMASGHIRDFQITASGQYGQWAPKLARLHYSGSINAWSTKEPFSWIKVDLLAP MIIHGIKTQGARQKFSSLYISQFIIMYSLDGKKWQTYRGNSTGTLMVFFGNVDSSGIKHNIFNP PIIARYIRLHPTHYSIRSTLRMELMGCDLNSCSMPLGMESKAISDAQITASSYFTNMFATWSPS KARLHLQGRSNAWRPQVNNPKEWLQVDFQKTMKVTGVTTQGVKSLLTSMYVKEFLISSSQD GHQWTLFFQNGKVKVFQGNQDSFTPVVNSLDPPLLTRYLRIHPQSWVHQIALRMEVLGCEA QDLYKLTRAETGGASPGTSSTGSPGSSPSASTGTGPGSSPSASTGTGPGTPGSGTASSSPGSSTP SGATGSPGSSPSASTGTGPGASPGTSSTGSPGTPGSGTASSSPGSSTPSGATGSPGTPGSGTASSS PGASPGTSSTGSPGASPGTSSTGSPGTPGSGTASSSPGSSTPSGATGSPGASPGTSSTGSPGTPGS GTASSSPGSSTPSGATGSPGSSPSASTGTGPGSSPSASTGTGPGSSTPSGATGSPGSSTPSGATGS PGASPGTSSTGSPGASPGTSSTGSPGASPGTSSTGSPGASPGTSSTGSPGASPGTSSTGSPGASPG TSSTGSPGASPGTSSTGSPGSSPSASTGTGPGTPGSGTASSSPGASPGTSSTGSPGASPGTSSTGS PGASPGTSSTGSPGSSTPSGATGSPGSSTPSGATGSPGASPGTSSTGSPGTPGSGTASSSPGSSTP SGATGSPGSSTPSGATGSPGSSTPSGATGSPGSSPSASTGTGPGASPGTSSTGSPGASPGTSSTGS PGTPGSGTASSSPGASPGTSSTGSPGASPGTSSTGSPGASPGTSSTGSPGASPGTSSTGSPGTPGS GTASSSPGSSTPSGATGSPGTPGSGTASSSPGSSTPSGATGSPGTPGSGTASSSPGSSTPSGATGS PGSSTPSGATGSPGSSPSASTGTGPGSSPSASTGTGPGASPGTSSTGSPGTPGSGTASSSPGSSTP SGATGSPGSSPSASTGTGPGSSPSASTGTGPGASPGTSSTGSPGASPGTSSTGSPGSSTPSGATGS PGSSPSASTGTGPGASPGTSSTGSPGSSPSASTGTGPGTPGSGTASSSPGSSTPSGATGSPGSSTP SGATGSPGASPGTSSTGSP |
| FVIII BDD9 (1-745) AG288_2-(1640-Y2332)-FXIa-AG864 | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPPSGETVFMSMENPG LWILGCHNSDFRNRGMTALLKVSSCDKNTGDYYEDSYEDISAYLLSKNNAIEPRSFSQNGPG ASPGTSSTGSPGASPGTSSTGSPGTPGSGTASSSPGSSTPSGATGSPGTPGSGTASSSPGSSTPSG ATGSPGTPGSGTASSSPGSSTPSGATGSPGSSTPSGATGSPGSSPSASTGTGPGSSPSASTGTGPG ASPGTSSTGSPGTPGSGTASSSPGSSTPSGATGSPGTPGSGTASSSPGSSTPSGATGSPGSSPSAST STGSPGASPGTSSTGSPGSSTPSGATGSPGSSPSASTGTGPGASPGTSSTGSPGSSPSASTGTGPG TPGSGTASSSPGSSTPSGATGSPPVLKRHQREITRTTLQSDQEEIDYDDTISVEMKKEDFDIYDE DENQSPRSFQKKTRHYFIAAVERLWDYGMSSSPHVLRNRAQSGSVPQFKKVVFQEFTDGSFT QPLYRGELNEHLGLLGPYIRAEVEDNIMVTFRNQASRPYSFYSSLISYEEDQRQGAEPRKNFV KPNETKTYFWKVQHHMAPTKDEFDCKAWAYFSDVDLEKDVHSGLIGPLLVCHTNTLNPAH GRQVTVQEFALFFTIFDETKSWYFTENMERNCRAPCNIQMEDPTFKENYRFHAINGYIMDTLP GLVMAQDQRIRWYLLSMGSNENIHSIHFSGHVFTVRKKEEYKMALYNLYPGVFETVEMLPS KAGIWRVECLIGEHLHAGMSTLFLVYSNKCQTPLGMASGHIRDFQITASGQYGQWAPKLARL HYSGSINAWSTKEPFSWIKVDLLAPMIIHGIKTQGARQKFSSLYISQFIIMYSLDGKKWQTYRG NSTGTLMVFFGNVDSSGIKHNIFNPPIIARYIRLHPTHYSIRSTLRMELMGCDLNSCSMPLGME SKAISDAQITASSYFTNMFATWSPSKARLHLQGRSNAWRPQVNNPKEWLQVDFQKTMKVTG VTTQGVKSLLTSMYVKEFLISSSQDGHQWTLFFQNGKVKVFQGNQDSFTPVVNSLDPPLLTR YLRIHPQSWVHQIALRMEVLGCEAQDLYKLTRAETGGASPGTSSTGSPGSSPSASTGTGPGSS PSASTGTGPGTPGSGTASSSPGSSTPSGATGSPGSSPSASTGTGPGASPGTSSTGSPGTPGSGTAS SSPGSSTPSGATGSPGTPGSGTASSSPGASPGTSSTGSPGASPGTSSTGSPGTPGSGTASSSPGSS TPSGATGSPGASPGTSSTGSPGTPGSGTASSSPGSSTPSGATGSPGSSPSASTGTGPGSSPSASTG TGPGSSTPSGATGSPGSSTPSGATGSPGASPGTSSTGSPGASPGTSSTGSPGSSPSASTGTGPTP GSGTASSSPGASPGTSSTGSPGASPGTSSTGSPGASPGTSSTGSPGSSTPSGATGSPGSSTPSGAS PGTSSTGSPGTPGSGTASSSPGSSTPSGATGSPGSSTPSGATGSPGSSTPSGATGSPGSSPSASTG TGPGASPGTSSTGSPGASPGTSSTGSPGTPGSGTASSSPGSSTPSGATGSPGTPGSGTASSSPGSA TGSPGTPGSGTASSSPGSSTPSGATGSPGSSTPSGATGSPGSSPSASTGTGPGSSPSASTGTGPGAS PGTSSTGSPGTPGSGTASSSPGSSTPSGATGSPGSSPSASTGTGPGSSPSASTGTGPGASPGTSST GSPGASPGTSSTGSPGSSPSASTGTGPGASPGTSSTGSPGSSPSASTGTGPGTPGSGTASSSPGSSTPSGATGSPGSSTPSGATGSPGASPGTSSTGSP |
| FVIII BDD9 (1-743) AG288_2-(1638-Y2332)-FXIa- | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| AG864 | TDETFKTREAIQHESGILGPLLYGEVGDTLLIIFKNQASRPYNIYPHGITDVRPLYSRRLPKGVK
HLKDFPILPGEIFKYKWTVTVEDGPTKSDPRCLTRYYSSFVNMERDLASGLIGPLLICYKESVD
QRGNQIMSDKRNVILFSVFDENRSWYLTENIQRFLPNPAGVQLEDPEFQASNIMHSINGYVFD
SLQLSVCLHEVAYWYILSIGAQTDFLSVFFSGYTFKHKMVYEDTLTLFPFSGETVFMSMENPG
LWILGCHNSDFRNRGMTALLKVSSCDKNTGDYYEDSYEDISAYLLSKNNAIEPRSFSGPGASP
GTSSTGSPGASPGTSSTGSPGTPGSGTASSSPGSSTPSGATGSPGTPGSGTASSSPGSSTPSGATG
SPGTPGSGTASSSPGSSTPSGATGSPGSSTPSGATGSPGSSPSASTGTGPGSSPSASTGTGPGASP
GTSSTGSPGTPGSGTASSSPGSSTPSGATGSPGSSPSASTGTGPGSSPSASTGTGPGASPGTSSTG
SPGASPGTSSTGSPGSSTPSGATGSPGSSPSASTGTGPGASPGTSSTGSPGSSPSASTGTGPGTPG
SGTASSSPGSSTPSGATGSQNPPVLKRHQREITRTTLQSDQEEIDYDDTISVEMKKEDFDIYDE
DENQSPRSFQKKTRHYFIAAVERLWDYGMSSSPHVLRNRAQSGSVPQFKKVVFQEFTDGSFT
QPLYRGELNEHLGLLGPYIRAEVEDNIMVTFRNQASRPYSFYSSLISYEEDQRQGAEPRKNFV
KPNETKTYFWKVQHHMAPTKDEFDCKAWAYFSDVDLEKDVHSGLIGPLLVCHTNTLNPAH
GRQVTVQEFALFFTIFDETKSWYFTENMERNCRAPCNIQMEDPTFKENYRFHAINGYIMDTLP
GLVMAQDQRIRWYLLSMGSNENIHSIHFSGHVFTVRKKEEYKMALYNLYPGVFETVEMLPS
KAGIWRVECLIGEHLHAGMSTLFLVYSNKCQTPLGMASGHIRDFQITASGQYGQWAPKLARL
HYSGSINAWSTKEPFSWIKVDLLAPMIIHGIKTQGARQKFSSLYISQFIIMYSLDKKWQTYRG
NSTGTLMVFFGNVDSSGIKHNIFNPPIIARYIRLHPTHYSIRSTLRMELMGCDLNSCSMPLGME
SKAISDAQITASSYFTNMFATWSPSKARLHLQGRSNAWRPQVNNPKEWLQVDFQKTMKVTG
VTTQGVKSLLTSMYVKEFLISSSQDGHQWTLFFQNGKVKVFQGNQDSFTPVVNSLDPPLLTR
YLRIHPQSWVHQIALRMEVLGCEAQDLYKLTRAETGGASPGTSSTGSPGSSPSASTGTGPGSS
PSASTGTGPGTPGSGTASSSPGSSTPSGATGSPGSSPSASTGTGPGASPGTSSTGSPGTPGSGTAS
SSPGSSTPSGATGSPGTPGSGTASSSPGASPGTSSTGSPGTPGSGTASSSPGSS
TPSGATGSPGASPGTSSTGSPGTPGSGTASSSPGSSTPSGATGSPGSSPSASTGTGPGSSPSASTG
TGPGSSTPSGATGSPGSSTPSGATGSPGASPGTSSTGSPGASPGTSSTGSPGASPGTSSTGSPGTP
GSGTASSSPGASPGTSSTGSPGASPGTSSTGSPGASPGTSSTGSPGSSPSASTGTGPGTPGSGTAS
SSPGSSTGSPGASPGTSSTGSPGASPGTSSTGSPGSSTPSGATGSPGSSTPSGATGSPGAS
PGTSSTGSPGTPGSGTASSSPGSSTPSGATGSPGSSTPSGATGSPGSSPSASTG
TGPGASPGTSSTGSPGASPGTSSTGSPGTPGSGTASSSPGASPGTSSTGSPGASPGTSSTGSPGAS
PGTSSTGSPGASPGTSSTGSPGTPGSGTASSSPGSSTPSGATGSPGTPGSGTASSSPGSSTPSGAT
GSPGTPGSGTASSSPGSSTPSGATGSPGSSTPSGATGSPGSSPSASTGTGPGSSPSASTGTGPGAS
PGTSSTGSPGTPGSGTASSSPGSSTPSGATGSPGSSPSASTGTGPGSSPSASTGTGPGASPGTSST
GSPGASPGTSSTGSPGSSTPSGATGSPGSSPSASTGTGPGASPGTSSTGSPGSSPSASTGTGPGTP
GSGTASSSPGSSTPSGATGSPGSSTPSGATGSPGASPGTSSTGSP |
| BDD10 (1-745) AG288_2-(1640-Y2332)-FXIa-AG864 | ATRRYYLGAVELSWDYMQSDLGELPVDARFPPRVPKSFPFNTSVVYKKTLFVEFTDHLFNIA
KPRPPWMGLLGPTIQAEVYDTVVITLKNMASHPVSLHAVGVSYWKASEGAEYDDQTSQREK
EDDKVFPGGSHTYVWQVLKENGPMASDPLCLTYSYLSHVDLVKDLNSGLIGALLVCREGSL
AKEKTQTLHKFILLFAVFDEGKSWHSETKNSLMQDRDAASARAWPKMHTVNGYVNRSLPGL
IGCHRKSVYWHVIGMGTTPEVHSIFLEGHTFLVRNHRQASLEISPITFLTAQTLLMDLGQFLLF
CHISSHQHDGMEAYVKVDSCPEEPQLRMKNNEEAEDYDDDLTDSEMDVVRFDDDNSPSFIQI
RSVAKKHPKTWVHYIAAEEEDWDYAPLVLAPDDRSYKSQYLNNGPQRIGRKYKKVRFMAY
TDETFKTREAIQHESGILGPLLYGEVGDTLLIIFKNQASRPYNIYPHGITDVRPLYSRRLPKGVK
HLKDFPILPGEIFKYKWTVTVEDGPTKSDPRCLTRYYSSFVNMERDLASGLIGPLLICYKESVD
QRGNQIMSDKRNVILFSVFDENRSWYLTENIQRFLPNPAGVQLEDPEFQASNIMHSINGYVFD
SLQLSVCLHEVAYWYILSIGAQTDFLSVFFSGYTFKHKMVYEDTLTLFPFSGETVFMSMENPG
LWILGCHNSDFRNRGMTALLKVSSCDKNTGDYYEDSYEDISAYLLSKNNAIEPRSFSQNGPG
ASPGTSSTGSPGASPGTSSTGSPGTPGSGTASSSPGSSTPSG
ATGSPGTPGSGTASSSPGSSTPSGATGSPGSSTPSGATGSPGSSPSASTGTGPGSSPSASTGTGPG
ASPGTSSTGSPGTPGSGTASSSPGSSTPSGATGSPGSSPSASTGTGPGSSPSASTGTGPGASPGTS
STGSPGASPGTSSTGSPGSSTPSGATGSPGSSPSASTGTGPGASPGTSSTGSPGSSPSASTGTGPG
TPGSGTASSSPGSSTPSGATGSPPVLKRHQAEITRTTLQSDQEEIDYDDTISVEMKKEDFDIYDE
DENQSPRSFQKKTRHYFIAAVERLWDYGMSSSPHVLRNRAQSGSVPQFKKVVFQEFTDGSFT
QPLYRGELNEHLGLLGPYIRAEVEDNIMVTFRNQASRPYSFYSSLISYEEDQRQGAEPRKNFV
KPNETKTYFWKVQHHMAPTKDEFDCKAWAYFSDVDLEKDVHSGLIGPLLVCHTNTLNPAH
GRQVTVQEFALFFTIFDETKSWYFTENMERNCRAPCNIQMEDPTFKENYRFHAINGYIMDTLP
GLVMAQDQRIRWYLLSMGSNENIHSIHFSGHVFTVRKKEEYKMALYNLYPGVFETVEMLPS
KAGIWRVECLIGEHLHAGMSTLFLVYSNKCQTPLGMASGHIRDFQITASGQYGQWAPKLARL
HYSGSINAWSTKEPFSWIKVDLLAPMIIHGIKTQGARQKFSSLYISQFIIMYSLDKKWQTYRG
NSTGTLMVFFGNVDSSGIKHNIFNPPIIARYIRLHPTHYSIRSTLRMELMGCDLNSCSMPLGME
SKAISDAQITASSYFTNMFATWSPSKARLHLQGRSNAWRPQVNNPKEWLQVDFQKTMKVTG
VTTQGVKSLLTSMYVKEFLISSSQDGHQWTLFFQNGKVKVFQGNQDSFTPVVNSLDPPLLTR
YLRIHPQSWVHQIALRMEVLGCEAQDLYKLTRAETGGASPGTSSTGSPGSSPSASTGTGPGSS
PSASTGTGPGTPGSGTASSSPGSSTPSGATGSPGSSPSASTGTGPGASPGTSSTGSPGTPGSGTAS
SSPGSSTPSGATGSPGTPGSGTASSSPGASPGTSSTGSPGTPGSGTASSSPGSS
TPSGATGSPGASPGTSSTGSPGTPGSGTASSSPGSSTPSGATGSPGSSPSASTGTGPGSSPSASTG
TGPGSSTPSGATGSPGSSTPSGATGSPGASPGTSSTGSPGASPGTSSTGSPGASPGTSSTGSPGTP
GSGTASSSPGASPGTSSTGSPGASPGTSSTGSPGASPGTSSTGSPGSSPSASTGTGPGTPGSGTAS
SSPGSSTPSGATGSPGSSTPSGATGSPGASPGTSSTGSPGASPGTSSTGSPGSSTPSGATGSPGAS
PGTSSTGSPGTPGSGTASSSPGSSTPSGATGSPGSSTPSGATGSPGSSPSASTG
TGPGASPGTSSTGSPGASPGTSSTGSPGTPGSGTASSSPGSSTPSGATGSPGSSPSASTGTGPGAS
PGTSSTGSPGTPGSGTASSSPGSSTPSGATGSPGSSPSASTGTGPGSSPSASTGTGPGASPGTSST |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | GSPGASPGTSSTGSPGSSTPSGATGSPGSSPSASTGTGPGASPGTSSTGSPGSSPSASTGTGPGTP GSGTASSSPGSSTPSGATGSPGSSTPSGATGSPGASPGTSSTGSP |
| FVIII BDD10- FXIa- AG288_2 | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSENPG LWILGCHNSDFRNRGMTALLKVSSCDKNTGDYYEDSYEDISAYLLSKNNAIEPRSFSQNPPVL KRHQAEITRTTLQSDQEEIDYDDTISVEMKKEDFDIYDEDENQSPRSFQKKTRHYFIAAVERL WDYGMSSSPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHHMAPTKDEF DCKAWAYFSDVDLEKDVHSGLIGPLLVCHTNTLNPAHGRQVTVQEFALFFTIFDETKSWYFT ENMERNCRAPCNIQMEDPTFKENYRFHAINGYIMDTLPGLVMAQDQRIRWYLLSMGSNENIH SIHFSGHVFTVRKKEEYKMALYNLYPGVFETVEMLPSKAGIWRVECLIGEHLHAGMSTLFLV YSNKCQTPLGMASGHIRDFQITASGQYGQWAPKLARLHYSGSINAWSTKEPFSWIKVDLLAP MIIHGIKTQGARQKFSSLYISQFIIMYSLDGKKWQTYRGNSTGTLMVFFGNVDSSGIKHNIFNP PIIARYIRLHPTHYSIRSTLRMELMGCDLNSCSMPLGMESKAISDAQITASSYFTNMFATWSPS KARLHLQGRSNAWRPQVNNPKEWLQVDFQKTMKVTGVTTQGVKSLLTSMYVKEFLISSSQD GHQWTLFFQNGKVKVFQGNQDSFTPVVNSLDPPLLTRYLRIHPQSWVHQIALRMEVLGCEA QDLYKLTRAETGAGSPGAETAPGASPGTSSTGSPGASPGTSSTGSPGSGTASSSPGSSTPSG ATGSPGTPGSGTASSSPGSSTPSGATGSPGTPGSGTASSSPGSSTPSGATGSPGSSTPSGATGSPG SSPSASTGTGPGSSPSASTGTGPGASPGTSSTGSPGTPGSGTASSSPGSSTPSGATGSPGSSPSAS TGTGPGSSPSASTGTGPGASPGTSSTGSPGASPGTSSTGSPGSSTPSGATGSPGSSPSASTGTGPG ASPGTSSTGSPGSSPSASTGTGPGTPGSGTASSSPGSSTPSGATGSGAETAEQKLISEEDLSPATG |
| FVIII BDD10- FXIa- AG864 | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL IGCHRKSVYWHVIGMGTTPEVHSIFLEGHTFLVRNHRQASLEISPITFLTAQTLLMDLGQFLLF CHISSHQHDGMEAYVKVDSCPEEPQLRMKNNEEAEDYDDDLTDSEMDVVRFDDDNSPSFIQI RSVAKKHPKTWVHYIAAEEEDWDYAPLVLAPDDRSYKSQYLNNGPQRIGRKYKKVRFMAY TDETFKTREAIQHESGILGPLLYGEVGDTLLIIFKNQASRPYNIYPHGITDVRPLYSRRLPKGVK HLKDFPILPGEIFKYKWTVTVEDGPTKSDPRCLTRYYSSFVNMERDLASGLIGPLLICYKESVD QRGNQIMSDKRNVILFSVFDENRSWYLTENIQRFLPNPAGVQLEDPEFQASNIMHSINGYVFD SLQLSVCLHEVAYWYILSIGAQTDFLSVFFSGYTFKHKMVYEDTLTLFPFSGETVFMSENPG LWILGCHNSDFRNRGMTALLKVSSCDKNTGDYYEDSYEDISAYLLSKNNAIEPRSFSQNPPVL KRHQAEITRTTLQSDQEEIDYDDTISVEMKKEDFDIYDEDENQSPRSFQKKTRHYFIAAVERL WDYGMSSSPHVLRNRAQSGSVPQFKKVVFQEFTDGSFTQPLYRGELNEHLGLLGPYIRAEVE DNIMVTFRNQASRPYSFYSSLISYEEDQRQGAEPRKNFVKPNETKTYFWKVQHHMAPTKDEF DCKAWAYFSDVDLEKDVHSGLIGPLLVCHTNTLNPAHGRQVTVQEFALFFTIFDETKSWYFT ENMERNCRAPCNIQMEDPTFKENYRFHAINGYIMDTLPGLVMAQDQRIRWYLLSMGSNENIH SIHFSGHVFTVRKKEEYKMALYNLYPGVFETVEMLPSKAGIWRVECLIGEHLHAGMSTLFLV YSNKCQTPLGMASGHIRDFQITASGQYGQWAPKLARLHYSGSINAWSTKEPFSWIKVDLLAP MIIHGIKTQGARQKFSSLYISQFIIMYSLDGKKWQTYRGNSTGTLMVFFGNVDSSGIKHNIFNP PIIARYIRLHPTHYSIRSTLRMELMGCDLNSCSMPLGMESKAISDAQITASSYFTNMFATWSPS KARLHLQGRSNAWRPQVNNPKEWLQVDFQKTMKVTGVTTQGVKSLLTSMYVKEFLISSSQD GHQWTLFFQNGKVKVFQGNQDSFTPVVNSLDPPLLTRYLRIHPQSWVHQIALRMEVLGCEA QDLYKLTRAETGGASPGTSSTGSPGSSPSASTGTGPGSSPSASTGTGPGTPGSGTASSSPGSSTP SGATGSPGSSPSASTGTGPGASPGTSSTGSPGTPGSGTASSSPGSSTPSGATGSPGTPGSGTASSS PGASPGTSSTGSPGASPGTSSTGSPGTPGSGTASSSPGSSTPSGATGSPGASPGTSSTGSPGTPGS GTASSSPGSSTPSGATGSPGSSPSASTGTGPGSSPSASTGTGPGSSTPSGATGSPGSSTPSGATGS PGASPGTSSTGSPGASPGTSSTGSPGASPGTSSTGSPGTPGSGTASSSPGASPGTSSTGSPGASPG TSSTGSPGASPGTSSTGSPGSSTGSSTGSPGSSPSASTGTGPGTPGSGTASSSPGASPGTSSTGS PGASPGTSSTGSPGSSTPSGATGSPGSSTPSGATGSPGASPGTSSTGSPGTPGSGTASSSPGSSTP SGATGSPGSSTPSGATGSPGSSTPSGATGSPGSSPSASTGTGPGASPGTSSTGSPGASPGTSSTGS PGTPGSGTASSSPGASPGTSSTGSPGASPGTSSTGSPGASPGTSSTGSPGASPGTSSTGSPGTPGS GTASSSPGSSTPSGATGSPGTPGSGTASSSPGSSTPSGATGS PGSSTPSGATGSPGSSPSASTGTGPGSSPSASTGTGPGASPGTSSTGSPGTPGSGTASSSPGSSTP SGATGSPGSSPSASTGTGPGSSPSASTGTGPGASPGTSSTGSPGASPGTSSTGSPGSSTPSGATGS PGSSPSASTGTGPGASPGTSSTGSPGSSPSASTGTGPGTPGSGTASSSPGSSTPSGATGSPGSSTP SGATGSPGASPGTSSTGSP |
| FVIII BDD10- FXIa- AE864 | ATRRYYLGAVELSWDYMQSDLGELPVDARFPPRVPKSFPFNTSVVYKKTLFVEFTDHLFNIA KPRPPWMGLLGPTIQAEVYDTVVITLKNMASHPVSLHAVGVSYWKASEGAEYDDQTSQREK EDDKVFPGGSHTYVWQVLKENGPMASDPLCLTYSYLSHVDLVKDLNSGLIGALLVCREGSL AKEKTQTLHKFILLFAVFDEGKSWHSETKNSLMQDRDAASARAWPKMHTVNGYVNRSLPGL |

TABLE 51-continued

Exemplary CFXTEN comprising FVIII, cleavage sequences and XTEN sequences (SEQ ID NOS 1555-1590, respectively, in order of appearance)

| CFXTEN Name | Amino AcidSequence |
|---|---|
| | IGCHRKSVYWHVIGMGTTPEVHSIFLEGHTFLVRNHRQASLEISPITFLTAQTLLMDLGQFLLF<br>CHISSHQHDGMEAYVKVDSCPEEPQLRMKNNEEAEDYDDDLTDSEMDVVRFDDDNSPSFIQI<br>RSVAKKHPKTWVHYIAAEEEDWDYAPLVLAPDDRSYKSQYLNNGPQRIGRKYKKVRFMAY<br>TDETFKTREAIQHESGILGPLLYGEVGDTLLIIFKNQASRPYNIYPHGITDVRPLYSRRLPKGVK<br>HLKDFPILPGEIFKYKWTVTVEDGPTKSDPRCLTRYYSSFVNMERDLASGLIGPLLICYKESVD<br>QRGNQIMSDKRNVILFSVFDENRSWYLTENIQRFLPNPAGVQLEDPEFQASNIMHSINGYVFD<br>SLQLSVCLHEVAYWYILSIGAQTDFLSVFFSGYTFKHKMVYEDTLTLFPFSGETVFMSMENPG<br>LWILGCHNSDFRNRGMTALLKVSSCDKNTGDYYEDSYEDISAYLLSKNNAIEPRSFSQNPPVL<br>KRHQAEITRTTLQSDQEEIDYDDTISVEMKKEDFDIYDEDENQSPRSFQKKTRHYFIAAVERL<br>WDYGMSSSPHVLRNRAQSGSVPQFKKVVFQEFTDGSFTQPLYRGELNEHLGLLGPYIRAEVE<br>DNIMVTFRNQASRPYSFYSSLISYEEDQRQGAEPRKNFVKPNETKTYFWKVQHHMAPTKDEF<br>DCKAWAYFSDVDLEKDVHSGLIGPLLVCHTNTLNPAHGRQVTVQEFALFFTIFDETKSWYFT<br>ENMERNCRAPCNIQMEDPTFKENYRFHAINGYIMDTLPGLVMAQDQRIRWYLLSMGSNENIH<br>SIHFSGHVFTVRKKEEYKMALYNLYPGVFETVEMLPSKAGIWRVECLIGEHLHAGMSTLFLV<br>YSNKCQTPLGMASGHIRDFQITASGQYGQWAPKLARLHYSGSINAWSTKEPFSWIKVDLLAP<br>MIIHGIKTQGARQKFSSLYISQFIIMYSLDGKKWQTYRGNSTGTLMVFFGNVDSSGIKHNIFNP<br>PIIARYIRLHPTHYSIRSTLRMELMGCDLNSCSMPLGMESKAISDAQITASSYFTNMFATWSPS<br>KARLHLQGRSNAWRPQVNNPKEWLQVDFQKTMKVTGVTTQGVKSLLTSMYVKEFLISSSQD<br>GHQWTLFFQNGKVKVFQGNQDSFTPVVNSLDPPLLTRYLRIHPQSWVHQIALRMEVLGCEA<br>QDLYKLTRAETGGSPAGSPTSTEEGTSESATPESGPGTSTEPSEGSAPGSPAGSPTSTEEGTSTE<br>PSEGSAPGTSTEPSEGSAPGTSESATPESGPGSEPATSGSETPGSEPATSGSETPGSPAGSPTSTE<br>EGTSESATPESGPGTSTEPSEGSAPGTSTEPSEGSAPGSPAGSPTSTEEGTSTEPSEGSAPGTSTE<br>PSEGSAPGTSESATPESGPGTSTEPSEGSAPGTSESATPESGPGTSESATPGTSTEPSEGSA<br>PGTSTEPSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPESGPGSEPAT<br>SGSETPGTSESATPESGPGSEPATSGSETPGTSESATPESGPGTSTEPSEGSAPGTSESATPESGP<br>GSPAGSPTSTEEGSPAGSPTSTEEGSPAGSPTSTEEGTSESATPESGPGTSTEPSEGSAPGTSESA<br>TPESGPGSEPATSGSETPGTSESATPESGPGSEPATSGSETPGTSESATPESGPGTSTEPSEGSAP<br>GSPAGSPTSTEEGTSESATPESGPGSEPATSGSETPGTSESATPESGPGSPAGSPTSTEEGSPAGS<br>PTSTEEGTSTEPSEGSAPGTSESATPESGPGTSESATPESGPGTSESATPESGPGSEPATSGSETP<br>GSEPATSGSETPGSPAGSPTSTEEGTSTEPSEGSAPGTSTEPSEGSAPGSEPATSGSETPGTSESA<br>TPESGPGTSTEPSEGSAP |

Sequence name reflects N- to C-terminus configuration of the FVIII variant and XTEN components: signal peptide (SP); linker (L); cleavage sequence (CS) may be denoted by protease name active on the sequence, and XTEN components by family name and length, with insertion points for components denoted by FVIII amino acid and numbered positions adjacent to the inserted sequence or A1 being the N-terminus and Y2332 being the C-terminus of the FVIII.

SEQUENCE LISTING (1700 sequences)

SEQ ID NO: 1 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 2 - protein, 2332 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 3 - protein, 2343 aa, Canus sp.
MQVELYTCCFLCLLPFSLSATRKYYLGAVELSWDYMQSDLLSALHADTSFSSRVPGSLPLTTSVTYRKTVFVEFTDDLFNIAKPRPPWMGLLGPTIQAEVYDTVVIVLKNMASHPVSLHAVGVSYWKASEGAEYEDQTSQKEKEDDNVIPGESHTYVWQVLKENGPMASDPPCLTYSYFSHVDLVKDLNSGLIGALLVCKEGSLAKERTQTLQEFVLLFAVFDEGKSWHSETNASLTQAEAQHELHTINGYVNRSLPGLTVCHKRSVYWHVIGMGTTPEVHSIFLEGHTFLVRNHRQASLEISPITFLTAQTFLMDLGQFLLFCHIPSHQHDGMEAYVKVDSCPEEPQLRMKNNEDKDYDDGLYDSDMDVVSFDDDSSSPFIQIRSVAKKHPKTWVHYIAAEEEDWDYAPSGPTPNDRSHKNLYLNNGPQRIGKKYKKVRFVAYTDETFKTREAIQYESGILGPLLYGEVGDTLLIIFKNQASRPYNIYPHGINYVTPLHTGRLPKGVKHLKDMPILPGEIFKYKWTVTVEDGPTKSDPRCLTRYYSSFINLERDLASGLIGPLLICYKESVDQRGNQMMSDKRNVILFSVFDENRSWYLTENMQRFLPNADVVQPHDPEFQLSNIMHSINGYVFDNLQLSVCLHEVAYWYILSVGAQTDFLSVFFSGYTFKHKMVYEDTLTLFPFSGETVFMSMENPGLWVLGCHNSDFRNRGMTALLKVSSCNRNIDDYYEDTYEDIPTPLLNENNVIKPRSFSQNSRHPSTKEKQLKATTTPENDIEKIDLQSGERTQLIKAQSVSSSDLLMLLGQNPTPRGLFLSDLREATDRADDHSRGAIERNKGPPEVASLRPELRHSEDREFTPEPELQLRLNENLGTNTTVELKKLDLKISSSSDSLMTSPTIPSDKLAAATEKTGSLGPPNMSVHFNSHLGTIVFGNNSSHLIQSGVPLELSEEDNDSKLLEAPLMNIQESSLRENVLSMESNRLFKEERIRGPASLIKDNALFKVNISSVKTNRAPVNLTTNRKTRVAIPTLLIENSTSVWQDIMLERNTEFKEVTSLIHNETFMDRNTTALGLNHVSNKTTLSKNVEMAHQKKEDPVPLRAENPDLSSSKIPFLPDWIKTHGKNSLSSEQRPSPKQLTSLGSEKSVKDQNFLSEEKVVVGEDEFTKDTELQEIFPNNKSIFFANLANVQENDTYNQEKKSPEEIERKEKLTQENVALPQAHTMIGTKNFLKNLFLLSTKQNVAGLEEQPYTPILQDTRSLNDSPHSEGIHMANFSKIREEANLEGLGNQTNQMVERFPSTTRMSSNASQHVITQRGKRSLKQPRLSQGEIKFERKVIANDTSTQWSKNMNYLAQGTLTQIEYNEKEKRAITQSPLSDCSMRNHVTIQMNDSALPVAKESASPSVRHTDLTKIPSQHNSSHLPASACNYTFRERTSGVQEGSHFLQEAKRNNLSLAFVTLGITEGQGKFSSLGKSATNQPMYKKLENTVLLQPGLSETSDKVELLSQVHVDQEDSFPTKTSNDSPGHLDLMGKIFLQKTQGPVKMNKTNSPGKVPFLKWATESSEKIPSKLLGVLAWDNHYDTQIPSEEWKSQKKSQTNTAFKRKDTILPLGPCENNDSTAAINEGQDKPQREAMWAKQGEPGRLCSQNPPVSKHHQREITVTTLQPEEDKFEYDDTFSIEMKREDFDIYGDYENQGLRSFQKKTRHYFIAAVERLWDYGMSRSPHILRNRAQSGDVQQFKKVVFQEFTDGSFTQPLYRGELNEHLGLLGPYIRAEVEDNIVVTFKNQASRPYSFYSSLISYDEDEGQGAEPRRKFVNPNETKIYFWKVQHHMAPTKDEFDCKAWAYFSDVDLEKDVHSGLIGPLLICRSNTLNPAHGRQVTVQEFALVFTIFDETKSWYFTENLERNCRAPCNVQKEDPTLKENFRFHAINGYVKDTLPGLVMAQDQKVRWYLLSMGSNENIHSIHFSGHVFTVRKKEEYKMAVYNLYPGVFETVEMLPSQVGIWRIECLIGEHLQAGMSTLFLVYSKKCQTPLGMASGHIRDFQITASGQYGQWAPKLARLHYSGSINAWSTKDPFSWIKVDLLAPMIIHGIMTQGARQKFSSLYVSQFIIMYSLDGNKWHSYRGNSTGTLMVFFGNVDSSGIKHNIFNPPIIAQYIRLHPTHYSIRSTLRMELLGCDFNSCSMPLGMESKAISDAQITASSYLSSMLATWSPSQARLHLQGRTNAWRPQANNPKEWLQVDFRKTMKVTGITTQGVKSLLISMYVKEFLISSSQDGHNWTLFLQNGKVKVFQGNRDSSTPVRNRLEPPLVARYVRLHPQSWAHHIALRLEVLGCDTQQPA

SEQ ID NO: 4 - protein, 2332 aa, Sus sp.; identical to SEQ ID NO: 2

SEQ ID NO: 5 - protein, 2300 aa, Mus sp.
AIRRYYLGAVELSWNYIQSDLLSVLHTDSRFLPRMSTSFPFNTSIMYKKTVFVEYKDQLFNIAKPRPPWMGLLGPTIWTEVHDTVVITLKNMASHPVSLHAVGVSYWKASEGDEYEDQTSQMEKEDDKVFPGESHTYVWQVLKENGPMASDPPCLTYSYMSHVDLVKDLNSGLIGALLVCKEGSLSKERTQMLYQFVLLFAVFDEGKSWHSETNDSYTQSMDSASARDWPKMHTVNGYVNRSLPGLIGCHRKSVYWHVIGMGTTPEIHSIFLEGHTFFVRNHRQASLEISPITFLTAQTLLIDLGQFLLFCHISSHKHDGMEAYVKVDSCPEESQWQKKNNNEEMEDYDDDLYSEMDMFTLDYDSSPFIQIRSVAKKYPKTWIHYISAEEEDWDYAPSVPTSDNGSYKSQYLSNGPHRIGRKYKKVRFIAYTDETFKTRETIQHESGLLGPLLYGEVGDTLLIIFKNQASRPYNIYPHGITDVSPLHARRLPRGIKHVKDLPIHPGEIFKYKWTVTVEDGPTKSDPRCLTRYYSSFINPERDLASGLIGPLLICYKESVDQRGNQMMSDKRNVILFSIFDENQSWYITENMQRFLPNAAKTQPQDPGFQASNIMHSINGYVFDSLELTVCLHEVAYWHILSVGAQTDFLSIFFSGYTFKHKMVYEDTLTLFPFSGETVFMSMENPGLWVLGCHNSDFRKRGMTALLKVSSCDKSTSDYYEEIYEDIPTQLVNENNVIDPRSFFQNTNHPNTRKKKFKDSTIPKNDMEKIEPQFEEIAEMLKVQSVSVSDMLMLLGQSHPTPHGLFLSDGQEAIYEAIHDDHSPNAIDSNEGPSKVTQLRPESHHSEKIVFTPQPGLQLRSNKSLETTIEVKWKKLGLQVSSLPSNLMTTTILSDNLKATFEKTDSSGFPDMPVHSSSKLSTTAFGKKAYSLVGSHVPLNASEENSDSNILDSTLMYSQESLPRDNILSIENDRLLREKRFHGIALLTKDNTLFKDNVSLMKTNKTYNHSTTNEKLHTESPTSIENSTTDLQDAILKVNSEIQEVTALIHDGTLLGKNSTYLRLNHMLNRTTSTKNKDIFHRKDEDPIPQDEENTIMPFSKMLFLSESSNWFKKTNGNNSLNSEQEHSPKQLVYLMFKKYVKNQSFLSEKNKVTVEQDGFTKNIGLKDMAFPHNMSIFLTTLSNVHENGRHNQEKNIQEEIEKEALIEEKVVLPQVHEATGSKNFLKDILILGTRQNISLYEVHVPVLQNITSINNSTNTVQIHMEHFFKRRKDKETNSEGLVNKTREMVKNYPSQKNITTQRSKRALGQFRLSTQWLKTINCSTQCIIKQIDHSKEMKKFITKSSLSDSSVIKSTTQTNSSDSHIVKTSAFPPIDLKRSPFQNKFSHVQASSYIYDFKTKSSRIQESNNFLKETKINNPSLAILPWNMFIDQGKFTSPGKSNTNSVTYKKRENIIFLKPTLPEESGKIELLPQVSIQEEEILPTETSHGSPGHLNLMKEVFLQKIQGPTKWNKAKRHGESIKGKTESSKNTRSKLLNHHAWDYHYAAQIPKDMWKSKEKSPEIISIKQEDTILSLRPHGNSHSIGANEKQNWPQRETTWVKQGQTQRTCSQIPPVLKRHQRELSAFQSEQEATDYDDAITIETIEDFDIYSEDIKQGPRSFQQKTRHYFIAAVERLWDYGMSTSHVLRNRYQSDNVPQFKKVVFQEFTDGSFSQPLYRGELNEHLGLLGPYIRAEVEDNIMVTFKNQASRPYSFYSSLISYKEDQRGEEPRRNFVKPNETKIYFWKVQHHMAPTEDEFDCKAWAYFSDVDLERDMHSGLIGPLLICHANTLNPAHGRQVSVQEFALLFTIFDETKSWYFTENVKRNCKTPCNFQMEDPTLKENYRFHAINGYVMDTLPGLVMAQDQRIRWYLLSMGNNENIQSIHFSGHVFTVRKKEEYKMAVYNLYPGVFETLEMIPSRAGIWRVECLIGEHLQAGMSTLFLVYSKQCQIPLGMASGSIRDFQITASGHYGQWAPNLARLHYSGSINAWSTKEPFSWIKVDLLAPMIVHGIKTQGARQKFSSLYISQFIIMYSLDGKKWLSYQGNSTGTLMVFFGNVDSSGIKHNSFNPPIIARYIRLHPTHSSIRSTLRMELMGCDLNSCSIPLGMESKVISDTQITASSYFTNMFATWSPSQARLHLQGRTNAWRPQVNDPKQWLQVDLQKTMKVTGIITQGVKSLFTSMFVKEFLISSSQDGHHWTQILYNGKVKVFQGNQDSSTPMMNSLDPPLLTRYLRIHPQIWEHQIALRLEILGCEAQQQY

SEQ ID NO: 6 - protein, 1457 aa, Artificial Sequence
  Description of Artificial Sequence: Synthetic polypeptide
MQIELSTCFFLCLLRFCFSATRRYYLGAVELSWDYMQSDLGELPVDARFPPRVPKSFPFNTSVVYKKTLFVEFTVHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 7 - protein, 1438 aa, Artificial Sequence
  Description of Artificial Sequence: Synthetic polypeptide
ATRRYYLGAVELSWDYMQSDLGELPVDARFPPRVPKSFPFNTSVVYKKTLFVEFTVHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 8 - protein, 1438 aa, Artificial Sequence
  Description of Artificial Sequence: Synthetic polypeptide
ATRRYYLGAVELSWDYMQSDLGELPVDARFPPRVPKSFPFNTSVVYKKTLFVEFTVHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQGEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 9 - protein, 1391 aa, Artificial Sequence
  Description of Artificial Sequence: Synthetic polypeptide
ATRRYYLGAVELSWDYMQSDLGELPVDARFPPRVPKSFPFNTSVVYKKTLFVEFTVHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 10 - protein, 1360 aa, Artificial Sequence
  Description of Artificial Sequence: Synthetic polypeptide
ATRRYYLGAVELSWDYMQSDLGELPVDARFPPRVPKSFPFNTSVVYKKTLFVEFTVHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 11 - protein, 1436 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 12 - protein, 1390 aa, Artificial Sequence
  Description of Artificial Sequence: Synthetic polypeptide
ATRRYYLGAVELSWDYMQSDLGELPVDARFPPRVPKSFPFNTSVVYKKTLFVEFTVHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 13 - protein, 1457 aa, Artificial Sequence
  Description of Artificial Sequence: Synthetic polypeptide
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 14 - protein, 1438 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 15 - protein, 1438 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 16 - protein, 1441 aa, Artificial Sequence
  Description of Artificial Sequence: Synthetic polypeptide
ATRATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 17 - protein, 1438 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQAEITRTTLQSDQEEIDYDDTISVEMKKEDFDIFDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 18 - protein, 1438 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIFDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 19 - protein, 12 aa, Artificial Sequence
  Description of Artificial Sequence: Synthetic peptide
GESPGGSSGSES

SEQ ID NO: 20 - protein, 12 aa, Artificial Sequence
  Description of Artificial Sequence: Synthetic peptide
GSEGSSGPGESS

SEQ ID NO: 21 - protein, 12 aa, Artificial Sequence
  Description of Artificial Sequence: Synthetic peptide
GSSESGSSEGGP

SEQ ID NO: 22 - protein, 12 aa, Artificial Sequence
  Description of Artificial Sequence: Synthetic peptide
GSGGEPSESGSS

SEQ ID NO: 23 - protein, 12 aa, Artificial Sequence
  Description of Artificial Sequence: Synthetic peptide
GSPAGSPTSTEE

SEQ ID NO: 24 - protein, 12 aa, Artificial Sequence
  Description of Artificial Sequence: Synthetic peptide
GSEPATSGSETP

SEQ ID NO: 25 - protein, 12 aa, Artificial Sequence
  Description of Artificial Sequence: Synthetic peptide
GTSESATPESGP

SEQ ID NO: 26 - protein, 12 aa, Artificial Sequence
  Description of Artificial Sequence: Synthetic peptide
GTSTEPSEGSAP

SEQ ID NO: 27 - protein, 12 aa, Artificial Sequence
  Description of Artificial Sequence: Synthetic peptide
GSTSESPSGTAP

SEQ ID NO: 28 - protein, 12 aa, Artificial Sequence
  Description of Artificial Sequence: Synthetic peptide
GTSTPESGSASP

SEQ ID NO: 29 - protein, 12 aa, Artificial Sequence
  Description of Artificial Sequence: Synthetic peptide
GTSPSGESSTAP

SEQ ID NO: 30 - protein, 12 aa, Artificial Sequence
  Description of Artificial Sequence: Synthetic peptide
GSTSSTAESPGP

SEQ ID NO: 31 - protein, 12 aa, Artificial Sequence
  Description of Artificial Sequence: Synthetic peptide
GTPGSGTASSSP

SEQ ID NO: 32 - protein, 12 aa, Artificial Sequence
  Description of Artificial Sequence: Synthetic peptide
GSSTPSGATGSP

SEQ ID NO: 33 - protein, 12 aa, Artificial Sequence
  Description of Artificial Sequence: Synthetic peptide
GSSPSASTGTGP

SEQ ID NO: 34 - protein, 12 aa, Artificial Sequence
  Description of Artificial Sequence: Synthetic peptide
GASPGTSSTGSP

SEQ ID NO: 35 - protein, 12 aa, Artificial Sequence
  Description of Artificial Sequence: Synthetic peptide
GEPAGSPTSTSE

SEQ ID NO: 36 - protein, 12 aa, Artificial Sequence
  Description of Artificial Sequence: Synthetic peptide
GTGEPSSTPASE

SEQ ID NO: 37 - protein, 12 aa, Artificial Sequence
  Description of Artificial Sequence: Synthetic peptide
GSGPSTESAPTE

SEQ ID NO: 38 - protein, 12 aa, Artificial Sequence
  Description of Artificial Sequence: Synthetic peptide
GSETPSGPSETA

SEQ ID NO: 39 - protein, 12 aa, Artificial Sequence
  Description of Artificial Sequence: Synthetic peptide
GPSETSTSEPGA

SEQ ID NO: 40 - protein, 12 aa, Artificial Sequence
  Description of Artificial Sequence: Synthetic peptide
GSPSEPTEGTSA

SEQ ID NO: 41 - protein, 12 aa, Artificial Sequence
  Description of Artificial Sequence: Synthetic peptide
GSGASEPTSTEP

SEQ ID NO: 42 - protein, 12 aa, Artificial Sequence
  Description of Artificial Sequence: Synthetic peptide
GSEPATSGTEPS

SEQ ID NO: 43 - protein, 12 aa, Artificial Sequence
  Description of Artificial Sequence: Synthetic peptide
GTSEPSTSEPGA

SEQ ID NO: 44 - protein, 12 aa, Artificial Sequence
  Description of Artificial Sequence: Synthetic peptide
GTSTEPSEPGSA

SEQ ID NO: 45 - protein, 12 aa, Artificial Sequence
  Description of Artificial Sequence: Synthetic peptide
GSTAGSETSTEA

SEQ ID NO: 46 - protein, 12 aa, Artificial Sequence
  Description of Artificial Sequence: Synthetic peptide
GSETATSGSETA

SEQ ID NO: 47 - protein, 12 aa, Artificial Sequence
  Description of Artificial Sequence: Synthetic peptide
GTSESATSESGA

SEQ ID NO: 48 - protein, 12 aa, Artificial Sequence
  Description of Artificial Sequence: Synthetic peptide
GTSTEASEGSAS

SEQ ID NO: 49 - protein, 42 aa, Artificial Sequence
  Description of Artificial Sequence: Synthetic polypeptide
GAPGSPAGSPTSTEEGTSESATPESGPGSEPATSGSETPASS

SEQ ID NO: 50 - protein, 42 aa, Artificial Sequence
  Description of Artificial Sequence: Synthetic polypeptide
TEPSEGSAPGSPAGSPTSTEEGTSESATPESGPGSEPATSGS

SEQ ID NO: 51 - protein, 42 aa, Artificial Sequence
  Description of Artificial Sequence: Synthetic polypeptide
PAGSPTSTEEGTSTEPSEGSAPGTSESATPESGPGSEPATSG

SEQ ID NO: 52 - protein, 42 aa, Artificial Sequence
  Description of Artificial Sequence: Synthetic polypeptide
SEPATSGSETPGTSESATPESGPGTSTEPSEGSAPGSPAGSP

SEQ ID NO: 53 - protein, 42 aa, Artificial Sequence
  Description of Artificial Sequence: Synthetic polypeptide
GAPSPSASTGTGPGTPGSGTASSSPGSSTPSGATGSPGPSGP

SEQ ID NO: 54 - protein, 42 aa, Artificial Sequence
  Description of Artificial Sequence: Synthetic polypeptide
GPGTPGSGTASSSPGSSTPSGATGSPGSSPSASTGTGPGASP

SEQ ID NO: 55 - protein, 42 aa, Artificial Sequence
  Description of Artificial Sequence: Synthetic polypeptide
SPSASTGTGPGASPGTSSTGSPGTPGSGTASSSPGSSTPSGA

SEQ ID NO: 56 - protein, 42 aa, Artificial Sequence
  Description of Artificial Sequence: Synthetic polypeptide
SASTGTGPGASPGTSSTGSPGTPGSGTASSSPGSSTPSGATG

SEQ ID NO: 57 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 58 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 59 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 60 - protein, 144 aa, Artificial Sequence
  Description of Artificial Sequence: Synthetic polypeptide
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 61 - protein, 144 aa, Artificial Sequence
  Description of Artificial Sequence: Synthetic polypeptide
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 62 - protein, 144 aa, Artificial Sequence; identical to SEQ ID NO: 61
  Description of Artificial Sequence: Synthetic polypeptide

SEQ ID NO: 63 - protein, 144 aa, Artificial Sequence
  Description of Artificial Sequence: Synthetic polypeptide
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 64 - protein, 144 aa, Artificial Sequence; identical to SEQ ID NO: 63
  Description of Artificial Sequence: Synthetic polypeptide

SEQ ID NO: 65 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 66 - protein, 144 aa, Artificial Sequence; identical to SEQ ID NO: 65
  Description of Artificial Sequence: Synthetic polypeptide

SEQ ID NO: 67 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 68 - protein, 144 aa, Artificial Sequence
  Description of Artificial Sequence: Synthetic polypeptide
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 69 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 70 - protein, 144 aa, Artificial Sequence
  Description of Artificial Sequence: Synthetic polypeptide
SGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASP

SEQ ID NO: 71 - protein, 144 aa, Artificial Sequence
  Description of Artificial Sequence: Synthetic polypeptide
PGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSS

SEQ ID NO: 72 - protein, 144 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSP

SEQ ID NO: 73 - protein, 144 aa, Artificial Sequence
  Description of Artificial Sequence: Synthetic polypeptide
GTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSP

SEQ ID NO: 74 - protein, 144 aa, Artificial Sequence
  Description of Artificial Sequence: Synthetic polypeptide
GTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSP

SEQ ID NO: 75 - protein, 144 aa, Artificial Sequence
  Description of Artificial Sequence: Synthetic polypeptide
GSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 76 - protein, 144 aa, Artificial Sequence
  Description of Artificial Sequence: Synthetic polypeptide
GTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSP

SEQ ID NO: 77 - protein, 144 aa, Artificial Sequence
  Description of Artificial Sequence: Synthetic polypeptide
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 78 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 79 - protein, 288 aa, Artificial Sequence
  Description of Artificial Sequence: Synthetic polypeptide
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 80 - protein, 288 aa, Artificial Sequence
  Description of Artificial Sequence: Synthetic polypeptide
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 81 - protein, 288 aa, Artificial Sequence
  Description of Artificial Sequence: Synthetic polypeptide
GSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSP

SEQ ID NO: 82 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 83 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 84 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 85 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 86 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 87 - protein, 576 aa, Artificial Sequence
  Description of Artificial Sequence: Synthetic polypeptide
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 88 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 89 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 90 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 91 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 92 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 93 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 94 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 95 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 96 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 97 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 98 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 99 - protein, 948 aa, Artificial Sequence
  Description of Artificial Sequence: Synthetic polypeptide
GTSTEPSEGSAPGTSESATPESGPGSEPATSGSETPGTSESATPESGPGTSTEPSEGSAPGSPAGSPTSTEEGTSTEPSEGSAPGSEPATSGSETPGTSESATPESGPGTSESATPESGPGSEPATSGSETPGTSTEPSEGSAPGTSESATPESGPGTSTEPSEGSAPGTSTEPSEGSAPGSEPATSGSETPGTSTEPSEGSAPGSEPATSGSETPGSEPATSGSETPGTSTEPSEGSAPGSEPATSGSETPGSEPATSGSETPGTSTEPSEGSAPGSEPATSGSETPGSPAGSPTSTEEGTSESATPESGPGTSTEPSEGSAPGSEPATSGSETPGTSESATPESGPGSEPATSGSETPGSEPATSGSETPGTSESATPESGPGSPAGSPTSTEEGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSESATPESGPGSPAGSPTSTEEGSPAGSPTSTEEGTSESATPESGPGTSESATPESGPGTSTEPSEGSAPGSPAGSPTSTEEGTSESATPESGPGTSTEPSEGSAPGSEPATSGSETPGSPAGSPTSTEEGTSESATPESGPGTSTEPSEGSAPGSEPATSGSETPGSEPATSGSETPGSEPATSGSETPGSPAGSPTSTEEGTSESATPESGPGSEPATSGSETPGSEPATSGSETPGSPAGSPTSTEEGSPAGSPTSTEEGSPAGSPTSTEEGTSESATPESGPGSEPATSGSETPGTSTEPSEGSAPGTSTEPSEGSAPGSPAGSPTSTEEGSPAGSPTSTEEGSPAGSPTSTEEGTSTEPSEGSAPGTSESATPESGPGTSESATPESGPGTSTEPSEGSAPGTSTEPSEGSAPGTSTEPSEGSAPGTSESATPESGPGTSESATPESGP

SEQ ID NO: 100 - protein, 1024 aa, Artificial Sequence
  Description of Artificial Sequence: Synthetic polypeptide
GSEPATSGSETPGSEPATSGSETPGTSTEPSEGSAPGTSESATPESGPGSPAGSPTSTEEGTSTEPSEGSAPGTSESATPESGPGTSESATPESGPGSEPATSGSETPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSPAGSPTSTEEGTSESATPESGPGSEPATSGSETPGTSTEPSEGSAPGSEPATSGSETPGTSESATPESGPGTSTEPSEGSAPGTSESATPESGPGTSTEPSEGSAPGTSTEPSEGSAPGSEPATSGSETPGSPAGSPTSTEEGTSESATPESGPGTSTEPSEGSAPGSPAGSPTSTEEGTSTEPSEGSAPGTSESATPESGPGTSTEPSEGSAPGSEPATSGSETPGSEPATSGSETPGTSESATPESGPGTSESATPESGPGTSESATPESGPGTSTEPSEGSAPGTSTEPSEGSAPGSPAGSPTSTEEGSPAGSPTSTEEGTSESATPESGPGSPAGSPTSTEEGSPAGSPTSTEEGTSESATPESGPGSEPATSGSETPGTSTEPSEGSAPGSEPATSGSETPGSPAGSPTSTEEGTSESATPESGPGTSESATPESGPGSEPATSGSETPGTSTEPSEGSAPGTSTEPSEGSAPGSPAGSPTSTEEGTSTEPSEGSAPGTSTEPSEGSAPGSEPATSGSETPGSPAGSPTSTEEGTSESATPESGPGTSTEPSEGSAPGSPAGSPTSTEEGTSESATPESGPGTSESATPESGPGTST

SEQ ID NO: 101 - protein, 1024 aa, Artificial Sequence
  Description of Artificial Sequence: Synthetic polypeptide
GSEPATSGSETPGSEPATSGSETPGTSTEPSEGSAPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGTSTEPSEGSAPGSEPATSGSETPGSPAGSPTSTEEGTSTEPSEGSAPGSEPATSGSETPGSPAGSPTSTEEGTSTEPSEGSAPGTSESATPESGPGSPAGSPTSTEEGTSTEPSEGSAPGTSESATPESGPGSEPATSGSETPGTSESATPESGPGSEPATSGSETPGTSTEPSEGSAPGTSTEPSEGSAPGTSTEPSEGSAPGSPAGSPTSTEEGSPAGSPTSTEEGTSESATPESGPGTSTEPSEGSAPGTSTEPSEGSAPGSPAGSPTSTEEGSPAGSPTSTEEGSPAGSPTSTEEGTSESATPESGPGSEPATSGSETPGTSESATPESGPGSPAGSPTSTEEGTSTEPSEGSAPGTSESATPESGPGSEPATSGSETPGSPAGSPTSTEEGTSTEPSEGSAPGTSESATPESGPGTSESATPESGPGSPAGSPTSTEEGTSTEPSEGSAPGSPAGSPTSTEEGSPAGSPTSTEEGTSESATPESGPGSEPATSGSETPGTSTEPSEGSAPGSEPATSGSETPGTSESATPESGPGTSTEPSEGSAPGTSESATPESGPGTSESATPESGPGTSTEPSEGSAPGTSTEPSEGSAPGSEPATSGSETPGTSESATPESGPGTSTEPSEGSAPGSEPATSGSETPGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGSPAGSPTSTEEGSPA

SEQ ID NO: 102 - protein, 1024 aa, Artificial Sequence
  Description of Artificial Sequence: Synthetic polypeptide
GSPAGSPTSTEEGTSTEPSEGSAPGSPAGSPTSTEEGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGSPAGSPTSTEEGTSTEPSEGSAPGSPAGSPTSTEEGTSTEPSEGSAPGSPAGSPTSTEEGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGSPAGSPTSTEEGTSESATPESGPGSEPATSGSETPGSEPATSGSETPGTSESATPESGPGTSESATPESGPGTSTEPSEGSAPGTSTEPSEGSAPGTSESATPESGPGSPAGSPTSTEEGTSTEPSEGSAPGSEPATSGSETPGSPAGSPTSTEEGTSTEPSEGSAPGTSTEPSEGSAPGSPAGSPTSTEEGSPAGSPTSTEEGSPAGSPTSTEEGTSESATPESGPGSEPATSGSETPGTSESATPESGPGTSESATPESGPGTSTEPSEGSAPGTSESATPESGPGSPAGSPTSTEEGTSESATPESGPGTSESATPESGPGTSTEPSEGSAPGSEPATSGSETPGTSTEPSEGSAPGSPAGSPTSTEEGTSESATPESGPGTSTEPSEGSAPGTSTEPSEGSAPGSEPATSGSETPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGSEPATSGSETPGTSTEPSEGSAPGSPAGSPTSTEEGSPAGSPTSTEEGTSESATPESGPGSEPATSGSETPGSPAGSPTSTEEGSPAGSPTSTEEGTSESATPESGPGSEPATSGSETPGTSTEPSEGSAPGTSTEPSEGSAPGSEP

SEQ ID NO: 103 - protein, 1024 aa, Artificial Sequence
  Description of Artificial Sequence: Synthetic polypeptide
GSPAGSPTSTEEGTSTEPSEGSAPGTSESATPESGPGTSESATPESGPGSEPATSGSETPGTSTEPSEGSAPGTSESATPESGPGSPAGSPTSTEEGTSTEPSEGSAPGTSESATPESGPGSPAGSPTSTEEGTSTEPSEGSAPGTSESATPESGPGTSTEPSEGSAPGSEPATSGSETPGSEPATSGSETPGSEPATSGSETPGTSESATPESGPGSPAGSPTSTEEGTSESATPESGPGSEPATSGSETPGTSESATPESGPGTSESATPESGPGSPAGSPTSTEEGTSTEPSEGSAPGTSESATPESGPGTSTEPSEGSAPGTSTEPSEGSAPGTSTEPSEGSAPGSEPATSGSETPGTSTEPSEGSAPGTSESATPESGPGTSESATPESGPGTSTEPSEGSAPGTSESATPESGPGTSESATPESGPGSEPATSGSETPGTSTEPSEGSAPGTSESATPESGPGSPAGSPTSTEEGSPAGSPTSTEEGTSTEPSEGSAPGSEPATSGSETPGSEPATSGSETPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSPAGSPTSTEEGTSESATPESGPGTSTEPSEGSAPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSESATPESGPGTSTEPSEGSAPGSEPATSGSETPGSEPATSGSETPGTSTEPSEGSAPGTSESATPESGPGSPAGSPTSTEEGTSTEPSEGSAPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGTST

SEQ ID NO: 104 - protein, 1024 aa, Artificial Sequence
  Description of Artificial Sequence: Synthetic polypeptide
GSEPATSGSETPGSPAGSPTSTEEGTSTEPSEGSAPGSEPATSGSETPGTSESATPESGPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSEPATSGSETPGTSESATPESGPGSEPATSGSETPGTSTEPSEGSAPGTSTEPSEGSAPGSEPATSGSETPGTSTEPSEGSAPGTSTEPSEGSAPGSPAGSPTSTEEGTSTEPSEGSAPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSPAGSPTSTEEGTSTEPSEGSAPGSPAGSPTSTEEGSPAGSPTSTEEGTSESATPESGPGSEPATSGSETPGSEPATSGSETPGTSTEPSEGSAPGSPAGSPTSTEEGSPAGSPTSTEEGTSESATPESGPGSEPATSGSETPGSEPATSGSETPGTSESATPESGPGSEPATSGSETPGSEPATSGSETPGTSESATPESGPGTSESATPESGPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGTSESATPESGPGSPAGSPTSTEEGTSTEPSEGSAPGSEPATSGSETPGTSTEPSEGSAPGSEPATSGSETPGTSTEPSEGSAPGTSTEPSEGSAPGSPAGSPTSTEEGTSESATPESGPGTSTEPSEGSAPGSEPATSGSETPGTSESATPESGPGTSESATPESGPGTSESATPESGPGTSTEPSEGSAPGSEPATSGSETPGSPAGSPTSTEEGTSESATPESGPGTSTEPSEGSAPGTSTEPSEGSAPGSPAGSPTSTEEGTSESATPESGPGTSTEPSEGSAPGTSTEPSEGSAPGSPAGSPTSTEEGTSESATPESGPGSPA

SEQ ID NO: 105 - protein, 1024 aa, Artificial Sequence
  Description of Artificial Sequence: Synthetic polypeptide
GTSTEPSEGSAPGTSTEPSEGSAPGTSTEPSEGSAPGTSTEPSEGSAPGSPAGSPTSTEEGSPAGSPTSTEEGTSESATPESGPGSEPATSGSETPGTSTEPSEGSAPGTSESATPESGPGTSTEPSEGSAPGTSESATPESGPGTSESATPESGPGSPAGSPTSTEEGTSTEPSEGSAPGSEPATSGSETPGTSTEPSEGSAPGSPAGSPTSTEEGTSTEPSEGSAPGSPAGSPTSTEEGSPAGSPTSTEEGSPAGSPTSTEEGTSESATPESGPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSPAGSPTSTEEGTSESATPESGPGTSESATPESGPGTSTEPSEGSAPGSEPATSGSETPGSEPATSGSETPGTSESATPESGPGSEPATSGSETPGTSTEPSEGSAPGSPAGSPTSTEEGTSTEPSEGSAPGSEPATSGSETPGSEPATSGSETPGSPAGSPTSTEEGTSESATPESGPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGTSESATPESGPGSPAGSPTSTEEGTSTEPSEGSAPGSEPATSGSETPGTSESATPESGPGSEPATSGSETPGTSESATPESGPGSEPATSGSETPGSEPATSGSETPGTSTEPSEGSAPGTSESATPESGPGTSTEPSEGSAPGTSTEPSEGSAPGTSESATPESGPGSPA

SEQ ID NO: 106 - protein, 1024 aa, Artificial Sequence
  Description of Artificial Sequence: Synthetic polypeptide
GSEPATSGSETPGTSTEPSEGSAPGSEPATSGSETPGTSTEPSEGSAPGTSESATPESGPGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGTSESATPESGPGTSTEPSEGSAPGTSESATPESGPGSEPATSGSETPGTSESATPESGPGTSESATPESGPGTSTEPSEGSAPGTSTEPSEGSAPGSEPATSGSETPGSPAGSPTSTEEGTSESATPESGPGSEPATSGSETPGSEPATSGSETPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGSPAGSPTSTEEGSPAGSPTSTEEGTSESATPESGPGSEPATSGSETPGSEPATSGSETPGTSTEPSEGSAPGTSESATPESGPGSPAGSPTSTEEGSPAGSPTSTEEGTSTEPSEGSAPGSPAGSPTSTEEGSPAGSPTSTEEGTSESATPESGPGSEPATSGSETPGTSTEPSEGSAPGTSTEPSEGSAPGSEPATSGSETPGSPAGSPTSTEEGTSESATPESGPGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGSPAGSPTSTEEGTSTEPSEGSAPGSEPATSGSETPGSEPATSGSETPGTSESATPESGPGTSESATPESGPGTSTEPSEGSAPGTSESATPESGPGSEPATSGSETPGTSESATPESGPGTSESATPESGPGTSTEPSEGSAPGTSESATPESGPGSEPATSGSETPGTSTEPSEGSAPGSPAGSPTSTEEGTSESATPESGPGTSTEPSEGSAPGTSTEPSEGSAPGSPAGSPTSTEEGTST

SEQ ID NO: 107 - protein, 1024 aa, Artificial Sequence
  Description of Artificial Sequence: Synthetic polypeptide
GTSESATPESGPGTSTEPSEGSAPGTSESATPESGPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSEPATSGSETPGSEPATSGSETPGTSESATPESGPGTSESATPESGPGSEPATSGSETPGTSESATPESGPGSPAGSPTSTEEGSPAGSPTSTEEGTSTEPSEGSAPGSEPATSGSETPGSPAGSPTSTEEGTSESATPESGPGSPAGSPTSTEEGTSTEPSEGSAPGSEPATSGSETPGSPAGSPTSTEEGTSESATPESGPGSPAGSPTSTEEGSPAGSPTSTEEGTSTEPSEGSAPGSEPATSGSETPGSPAGSPTSTEEGTSESATPESGPGTSTEPSEGSAPGSPAGSPTSTEEGTSESATPESGPGSEPATSGSETPGTSTEPSEGSAPGSPAGSPTSTEEGTSTEPSEGSAPGTSESATPESGPGTSESATPESGPGTSTEPSEGSAPGTSTEPSEGSAPGSEPATSGSETPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSEPATSGSETPGTSESATPESGPGSPAGSPTSTEEGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSPAGSPTSTEEGSPAGSPTSTEEGTSTEPSEGSAPGTSESATPESGPGTSESATPESGPGSPAGSPTSTEEGTSTEPSEGSAPGSPAGSPTSTEEGTSTEPSEGSAPGSPAGSPTSTEEGTSTEPSEGSAPGTSTEPSEGSAPGSEPATSGSETPGSPAGSPTSTEEGTSESATPESGPGSEPATSGSETPGSPAGSPTSTEEGTSESATPESGPGTSE

SEQ ID NO: 108 - protein, 1024 aa, Artificial Sequence
  Description of Artificial Sequence: Synthetic polypeptide
GTSESATPESGPGSPAGSPTSTEEGSPAGSPTSTEEGTSESATPESGPGSEPATSGSETPGTSTEPSEGSAPGTSTEPSEGSAPGTSTEPSEGSAPGSPAGSPTSTEEGTSTEPSEGSAPGTSESATPESGPGTSESATPESGPGSPAGSPTSTEEGSPAGSPTSTEEGSPAGSPTSTEEGTSESATPESGPGSEPATSGSETPGTSESATPESGPGTSTEPSEGSAPGTSESATPESGPGTSTEPSEGSAPGTSTEPSEGSAPGTSESATPESGPGSPAGSPTSTEEGTSESATPESGPGTSTEPSEGSAPGSPAGSPTSTEEGTSESATPESGPGSEPATSGSETPGTSTEPSEGSAPGSEPATSGSETPGSEPATSGSETPGTSESATPESGPGTSESATPESGPGTSTEPSEGSAPGTSESATPESGPGSPAGSPTSTEEGTSTEPSEGSAPGSEPATSGSETPGTSESATPESGPGSEPATSGSETPGTSTEPSEGSAPGTSESATPESGPGSPAGSPTSTEEGSPAGSPTSTEEGSPAGSPTSTEEGTSESATPESGPGSEPATSGSETPGTSESATPESGPGTSESATPESGPGSEPATSGSETPGTSTEPSEGSAPGTSTEPSEGSAPGTSTEPSEGSAPGTSESATPESGPGSEPATSGSETPGTSESATPESGPGSEPATSGSETPGTSTEPSEGSAPGSEPATSGSETPGSPAGSPTSTEEGTSESATPESGPGTSESATPESGPGTSESATPESGPGSPAGSPTSTEEGTSTEPSEGSAPGTSESATPESGPGTSESATPESGPGTSTEPSEGSAPGTSTEPSEGSAPGSPAGSPTSTEEGTSESATPESGPGSEPATSGSETPGTSESATPESGPGTSESATPESGPGTSTEPSEGSAPGSEPATSGSETPGTSESATPESGPGSPAGSPTSTEEGTSTEPSEGSAPGSEPATSGSETPGSPAGSPTSTEEGTSESATPESGPGSPAGSPTSTEEGTSTEPSEGSAPGSEP

SEQ ID NO: 109 - protein, 1024 aa, Artificial Sequence
  Description of Artificial Sequence: Synthetic polypeptide
GSEPATSGSETPGTSTEPSEGSAPGTSESATPESGPGSEPATSGSETPGTSTEPSEGSAPGSPAGSPTSTEEGTSESATPESGPGSPAGSPTSTEEGTSTEPSEGSAPGSEPATSGSETPGTSTEPSEGSAPGTSESATPESGPGSEPATSGSETPGSEPATSGSETPGTSESATPESGPGTSTEPSEGSAPGTSESATPESGPGTSESATPESGPGSPAGSPTSTEEGSPAGSPTSTEEGTSESATPESGPGTSESATPESGPGTSTEPSEGSAPGTSTEPSEGSAPGSPAGSPTSTEEGTSTEPSEGSAPGSEPATSGSETPGSEPATSGSETPGSEPATSGSETPGSEPATSGSETPGTSESATPESGPGTSESATPESGPGTSESATPESGPGTSTEPSEGSAPGTSESATPESGPGTSESATPESGPGTSTEPSEGSAPGSPAGSPTSTEEGTSTEPSEGSAPGSEPATSGSETPGSPAGSPTSTEEGTSESATPESGPGTSTEPSEGSAPGSEPATSGSETPGTSESATPESGPGTSESATPESGPGTSTEPSEGSAPGSEPATSGSETPGSPAGSPTSTEEGTSESATPESGPGTSESATPESGPGTSTEPSEGSAPGSEPATSGSETPGSPAGSPTSTEEGTSESATPESGPGSEPATSGSETPGTSTEPSEGSAPGSEPATSGSETPGSPAGSPTSTEEGTSESATPESGPGTSTEPSEGSAPGSEPATSGSETPGTSESATPESGPGTSESATPESGPGSPAGSPTSTEEGTSTEPSEGSAPGSPAGSPTSTEEGSPAGSPTSTEEGSPAGSPTSTEEGTSESATPESGPGSEPATSGSETPGTSTEPSEGSAPGTSTEPSEGSAPGTSESATPESGPGTSTEPSEGSAPGTSESATPESGPGSEPATSGSETPGTSTEPSEGSAPGTSESATPESGPGSPAGSPTSTEEGSPAGSPTSTEEGSPAGSPTSTEEGTSESATPESGPGSPAGSPTSTEEGTSESATPESGPGSEP

SEQ ID NO: 110 - protein, 1024 aa, Artificial Sequence
  Description of Artificial Sequence: Synthetic polypeptide
GTSTEPSEGSAPGSEPATSGSETPGTSTEPSEGSAPGTSTEPSEGSAPGSEPATSGSETPGSPAGSPTSTEEGSPAGSPTSTEEGTSESATPESGPGSEPATSGSETPGTSTEPSEGSAPGTSTEPSEGSAPGSPAGSPTSTEEGTSESATPESGPGTSESATPESGPGSPAGSPTSTEEGTSTEPSEGSAPGTSESATPESGPGTSTEPSEGSAPGSEPATSGSETPGTSESATPESGPGSEPATSGSETPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSPAGSPTSTEEGTSESATPESGPGTSTEPSEGSAPGSEPATSGSETPGTSESATPESGPGSEPATSGSETPGSPAGSPTSTEEGTSESATPESGPGTSESATPESGPGSEPATSGSETPGTSESATPESGPGTSESATPESGPGTSESATPESGPGTSTEPSEGSAPGTSESATPESGPGSEPATSGSETPGTSTEPSEGSAPGSPAGSPTSTEEGTSTEPSEGSAPGSEPATSGSETPGSPAGSPTSTEEGTSESATPESGPGTSESATPESGPGTSTEPSEGSAPGTSESATPESGPGTSTEPSEGSAPGTSESATPESGPGSEPATSGSETPGTSTEPSEGSAPGTSTEPSEGSAPGSPAGSPTSTEEGSPAGSPTSTEEGTSESATPESGPGTSTEPSEGSAPGTSESATPESGPGSPAGSPTSTEEGSPAGSPTSTEEGSPAGSPTSTEEGTSTEPSEGSAPGSPAGSPTSTEEGSPAGSPTSTEEGTSESATPESGPGSEPATSGSETPGSEPATSGSETPGTSESATPESGPGSEPATSGSETPGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGTSESATPESGPGTSE

SEQ ID NO: 111 - protein, 948 aa, Artificial Sequence
  Description of Artificial Sequence: Synthetic polypeptide
GSSTPSGATGSPGTPGSGTASSSPGASPGTSSTGSPGSSPSASTGTGPGTPGSGTASSSPGTPGSGTASSSPGTPGSGTASSSPGSSPSASTGTGPGTPGSGTASSSPGSSPSASTGTGPGSSTPSGATGSPGSSTPSGATGSPGSSPSASTGTGPGSSTPSGATGSPGASPGTSSTGSPGASPGTSSTGSPGSSPSASTGTGPGSSPSASTGTGPGASPGTSSTGSPGSSPSASTGTGPGASPGTSSTGSPGSSPSASTGTGPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGASPGTSSTGSPGASPGTSSTGSPGSSTPSGATGSPGSSPSASTGTGPGSSPSASTGTGPGTPGSGTASSSPGASPGTSSTGSPGTPGSGTASSSPGSSTPSGATGSPGSSTPSGATGSPGSSPSASTGTGPGSSPSASTGTGPGSSTPSGATGSPGASPGTSSTGSPGTPGSGTASSSPGSSPSASTGTGPGSSTPSGATGSPGASPGTSSTGSPGSSTPSGATGSPGTPGSGTASSSPGSSPSASTGTGPGSSTPSGATGSPGASPGTSSTGSPGASPGTSSTGSPGTPGSGTASSSPGTPGSGTASSSPGSSPSASTGTGPGASPGTSSTGSPGASPGTSSTGSPGTPGSGTASSSPGTPGSGTASSSPGSSTPSGATGSPGSSPSASTGTGPGSSTPSGATGSPGSSPSASTGTGPGSSPSASTGTGPGTPGSGTASSSPGSSTPSGATGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGTPGSGTASSSPGSSTPSGATGSPGSSTPSGATGSP

SEQ ID NO: 112 - protein, 1024 aa, Artificial Sequence
  Description of Artificial Sequence: Synthetic polypeptide
GTPGSGTASSSPGTPGSGTASSSPGSSPSASTGTGPGTPGSGTASSSPGASPGTSSTGSPGTPGSGTASSSPGSSPSASTGTGPGSSTPSGATGSPGASPGTSSTGSPGASPGTSSTGSPGSSPSASTGTGPGSSTPSGATGSPGSSPSASTGTGPGSSPSASTGTGPGTPGSGTASSSPGTPGSGTASSSPGASPGTSSTGSPGSSTPSGATGSPGSSPSASTGTGPGTPGSGTASSSPGASPGTSSTGSPGTPGSGTASSSPGSSPSASTGTGPGSSPSASTGTGPGASPGTSSTGSPGASPGTSSTGSPGSSTPSGATGSPGSSTPSGATGSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGASPGTSSTGSPGSSPSASTGTGPGTPGSGTASSSPGASPGTSSTGSPGASPGTSSTGSPGSSTPSGATGSPGTPGSGTASSSPGSSTPSGATGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGASPGTSSTGSPGTPGSGTASSSPGSSPSASTGTGPGTPGSGTASSSPGSSTPSGATGSPGSSTPSGATGSPGASPGTSSTGSPGSSPSASTGTGPGASPGTSSTGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGTPGSGTASSSPGSSPSASTGTGPGASPGTSSTGSPGSSTPSGATGSPGTPGSGTASSSPGSST

SEQ ID NO: 113 - protein, 1024 aa, Artificial Sequence
  Description of Artificial Sequence: Synthetic polypeptide
GASPGTSSTGSPGSSPSASTGTGPGSSTPSGATGSPGASPGTSSTGSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGASPGTSSTGSPGSSTPSGATGSPGTPGSGTASSSPGSSPSASTGTGPGSSTPSGATGSPGSSPSASTGTGPGSSTPSGATGSPGASPGTSSTGSPGSSPSASTGTGPGTPGSGTASSSPGASPGTSSTGSPGSSTPSGATGSPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGTPGSGTASSSPGSSPSASTGTGPGSSPSASTGTGPGASPGTSSTGSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSPSASTGTGPGTPGSGTASSSPGSSTPSGATGSPGSSTPSGATGSPGASPGTSSTGSPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGASPGTSSTGSPGSSTPSGATGSPGSSPSASTGTGPGSSPSASTGTGPGASPGTSSTGSPGSST

SEQ ID NO: 114 - protein, 1024 aa, Artificial Sequence
  Description of Artificial Sequence: Synthetic polypeptide
GSSPSASTGTGPGTPGSGTASSSPGSSPSASTGTGPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSPSASTGTGPGSSPSASTGTGPGSSTPSGATGSPGASPGTSSTGSPGSSPSASTGTGPGTPGSGTASSSPGTPGSGTASSSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGSSPSASTGTGPGASPGTSSTGSPGSSPSASTGTGPGSSTPSGATGSPGASPGTSSTGSPGASPGTSSTGSPGSSTPSGATGSPGSSPSASTGTGPGASPGTSSTGSPGASPGTSSTGSPGTPGSGTASSSPGSSTPSGATGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGASPGTSSTGSPGTPGSGTASSSPGASPGTSSTGSPGSSTPSGATGSPGASPGTSSTGSPGSSPSASTGTGPGTPGSGTASSSPGTPGSGTASSSPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASP

SEQ ID NO: 115 - protein, 1024 aa, Artificial Sequence
  Description of Artificial Sequence: Synthetic polypeptide
GSSTPSGATGSPGSSPSASTGTGPGTPGSGTASSSPGSSPSASTGTGPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGTPGSGTASSSPGASPGTSSTGSPGSSTPSGATGSPGSSTPSGATGSPGSSPSASTGTGPGTPGSGTASSSPGSSTPSGATGSPGSSTPSGATGSPGSSPSASTGTGPGTPGSGTASSSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGSSTPSGATGSPGSSPSASTGTGPGSSTPSGATGSPGTPGSGTASSSPGSSPSASTGTGPGSSTPSGATGSPGASPGTSSTGSPGASPGTSSTGSPGSSPSASTGTGPGASPGTSSTGSPGSSTPSGATGSPGASPGTSSTGSPGTPGSGTASSSPGTPGSGTASSSPGSSPSASTGTGPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSTPSGATGSPGSSPSASTGTGPGSSPSASTGTGPGASPGTSSTGSPGASPGTSSTGSPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPG

SEQ ID NO: 116 - protein, 1024 aa, Artificial Sequence
  Description of Artificial Sequence: Synthetic polypeptide
GTPGSGTASSSPGSSTPSGATGSPGASPGTSSTGSPGSSTPSGATGSPGTPGSGTASSSPGTPGSGTASSSPGSSTPSGATGSPGSSTPSGATGSPGASPGTSSTGSPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGASPGTSSTGSPGASPGTSSTGSPGTPGSGTASSSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGSSTPSGATGSPGSSPSASTGTGPGSSPSASTGTGPGASPGTSSTGSPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGTPGSGTASSSPGTPGSGTASSSPGSSPSASTGTGPGSSTPSGATGSPGASPGTSSTGSPGASPGTSSTGSPGSSTPSGATGSPGSSPSASTGTGPGASPGTSSTGSPGSSTPSGATGSPGTPGSGTASSSPGASPGTSSTGSPGTPGSGTASSSPGASPGTSSTGSPGSSTPSGATGSPGSSTPSGATGSPGASPGTSSTGSPGSSPSASTGTGPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSTPSGATGSPGSSTPSGATGSPGSSPSASTGTGPGSSTPSGATGSPGTPGSGTASSSPGSSPSASTGTGPGTPGSGTASSSPGSSTPSGATGSPGSSPSASTGTGPGSSPSASTGTGPGTPGSGTASSSPGASP

SEQ ID NO: 117 - protein, 1024 aa, Artificial Sequence
  Description of Artificial Sequence: Synthetic polypeptide
GSSTPSGATGSPGTPGSGTASSSPGTPGSGTASSSPGASPGTSSTGSPGSSTPSGATGSPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSPSASTGTGPGTPGSGTASSSPGASPGTSSTGSPGSSTPSGATGSPGASPGTSSTGSPGTPGSGTASSSPGSSTPSGATGSPGTPGSGTASSSPGSSPSASTGTGPGASPGTSSTGSPGASPGTSSTGSPGTPGSGTASSSPGSSTPSGATGSPGSSTPSGATGSPGSSPSASTGTGPGSSPSASTGTGPGASPGTSSTGSPGTPGSGTASSSPGTPGSGTASSSPGSSPSASTGTGPGASPGTSSTGSPGASPGTSSTGSPGTPGSGTASSSPGSSPSASTGTGPGASPGTSSTGSPGASPGTSSTGSPGSSTPSGATGSPGSSPSASTGTGPGSSPSASTGTGPGTPGSGTASSSPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSPSASTGTGPGSSTPSGATGSPGSSTPSGATGSPGSSPSASTGTGPGTPGSGTASSSPGSSPSASTGTGPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSTPSGATGSPGTPGSGTASSSPGSSPSASTGTGPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGASPGTSSTGSPGASPGTSSTGSPGSSTPSGATGSPGTPG

SEQ ID NO: 118 - protein, 1024 aa, Artificial Sequence
  Description of Artificial Sequence: Synthetic polypeptide
GSSTPSGATGSPGSSTPSGATGSPGTPGSGTASSSPGSSPSASTGTGPGTPGSGTASSSPGASPGTSSTGSPGSSTPSGATGSPGASPGTSSTGSPGTPGSGTASSSPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGASPGTSSTGSPGASPGTSSTGSPGSSTPSGATGSPGASPGTSSTGSPGTPGSGTASSSPGSSTPSGATGSPGSSTPSGATGSPGSSPSASTGTGPGSSPSASTGTGPGSSTPSGATGSPGSSPSASTGTGPGSSPSASTGTGPGASPGTSSTGSPGASPGTSSTGSPGTPGSGTASSSPGSSPSASTGTGPGSSPSASTGTGPGASPGTSSTGSPGSSPSASTGTGPGTPGSGTASSSPGSSPSASTGTGPGSSTPSGATGSPGASPGTSSTGSPGSSTPSGATGSPGTPGSGTASSSPGSSPSASTGTGPGASPGTSSTGSPGSSTPSGATGSPGASPGTSSTGSPGASPGTSSTGSPGTPGSGTASSSPGASPGTSSTGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGSSTPSGATGSPGSSPSASTGTGPGSSTPSGATGSPGSSPSASTGTGPGTPGSGTASSSPGTPGSGTASSSPGSSTPSGATGSPGSSTPSGATGSPGTPGSGTASSSPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGTPGSGTASSSPGTPGSGTASSSPGSSTPSGATGSPGSST

SEQ ID NO: 119 - protein, 1024 aa, Artificial Sequence
  Description of Artificial Sequence: Synthetic polypeptide
GASPGTSSTGSPGSSPSASTGTGPGSSTPSGATGSPGSSPSASTGTGPGTPGSGTASSSPGSSTPSGATGSPGSSTPSGATGSPGSSPSASTGTGPGSSTPSGATGSPGTPGSGTASSSPGSSPSASTGTGPGSSTPSGATGSPGASPGTSSTGSPGSSPSASTGTGPGSSPSASTGTGPGTPGSGTASSSPGASPGTSSTGSPGSSTPSGATGSPGSSPSASTGTGPGASPGTSSTGSPGSSTPSGATGSPGTPGSGTASSSPGSSPSASTGTGPGSSPSASTGTGPGSSPSASTGTGPGTPGSGTASSSPGTPGSGTASSSPGSSTPSGATGSPGTPGSGTASSSPGSSPSASTGTGPGASPGTSSTGSPGASPGTSSTGSPGTPGSGTASSSPGSSPSASTGTGPGASPGTSSTGSPGTPGSGTASSSPGSSTPSGATGSPGSSTPSGATGSPGASPGTSSTGSPGTPGSGTASSSPGSSPSASTGTGPGTPGSGTASSSPGASPGTSSTGSPGSSTPSGATGSPGASPGTSSTGSPGASPGTSSTGSPGTPGSGTASSSPGTPGSGTASSSPGSSPSASTGTGPGSSPSASTGTGPGSSPSASTGTGPGTPGSGTASSSPGASPGTSSTGSPGSSTPSGATGSPGASPGTSSTGSPGSSPSASTGTGPGASPGTSSTGSPGSSPSASTGTGPGASPGTSSTGSPGSSPSASTGTGPGSSPSASTGTGPGTPGSGTASSSPGASPGTSSTGSPGTPGSGTASSSPGTPGSGTASSSPGASPGTSSTGSPGSSTPSGATGSPGSSTPSGATGSPGSSPSASTGTGPGSSTPSGATGSPGTPGSGTASSSPGSSPSASTGTGPGSSTPSGATGSPGSSTPSGATGSPGSSPSASTGTGPGSSPSASTGTGPGASPGTSSTGSPGTPGSGTASSSPGSSPSASTGTGPGSSTPSGATGSPGASPGTSSTGSPGASPGTSSTGSPGSSPSASTGTGPGASPGTSSTGSPGASPGTSSTGSPGTPG

SEQ ID NO: 120 - protein, 1024 aa, Artificial Sequence
  Description of Artificial Sequence: Synthetic polypeptide
GSSTPSGATGSPGSSPSASTGTGPGASPGTSSTGSPGASPGTSSTGSPGTPGSGTASSSPGSSPSASTGTGPGASPGTSSTGSPGSSTPSGATGSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGTPGSGTASSSPGASPGTSSTGSPGSSTPSGATGSPGTPGSGTASSSPGSSPSASTGTGPGSSTPSGATGSPGTPGSGTASSSPGSSPSASTGTGPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGASPGTSSTGSPGASPGTSSTGSPGSSTPSGATGSPGTPGSGTASSSPGSSPSASTGTGPGTPGSGTASSSPGASPGTSSTGSPGTPGSGTASSSPGASPGTSSTGSPGSSTPSGATGSPGSSPSASTGTGPGSSPSASTGTGPGTPGSGTASSSPGASPGTSSTGSPGASPGTSSTGSPGTPGSGTASSSPGASPGTSSTGSPGSSTPSGATGSPGSSTPSGATGSPGSSPSASTGTGPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSTPSGATGSPGTPGSGTASSSPGSSPSASTGTGPGASPGTSSTGSPGSSTPSGATGSPGTPGSGTASSSPGSSTPSGATGSPGSSTPSGATGSPGSSTPSGATGSPGSSPSASTGTGPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGASPGTSSTGSPGSSTPSGATGSPGASP

SEQ ID NO: 121 - protein, 1024 aa, Artificial Sequence
  Description of Artificial Sequence: Synthetic polypeptide
GSSPSASTGTGPGSSPSASTGTGPGSSPSASTGTGPGTPGSGTASSSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGSSTPSGATGSPGSSPSASTGTGPGASPGTSSTGSPGSSPSASTGTGPGASPGTSSTGSPGASPGTSSTGSPGTPGSGTASSSPGTPGSGTASSSPGASPGTSSTGSPGTPGSGTASSSPGTPGSGTASSSPGSSPSASTGTGPGSSTPSGATGSPGASPGTSSTGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSPSASTGTGPGSSTPSGATGSPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGSSTPSGATGSPGTPGSGTASSSPGSSPSASTGTGPGASPGTSSTGSPGSSTPSGATGSPGSSPSASTGTGPGSSTPSGATGSPGASPGTSSTGSPGSSPSASTGTGPGTPGSGTASSSPGSSPSASTGTGPGSSTPSGATGSPGASPGTSSTGSPGSSPSASTGTGPGTPGSGTASSSPGSSTPSGATGSPGSSTPSGATGSPGASPGTSSTGSPGSSPSASTGTGPGSSP

SEQ ID NO: 122 - protein, 1024 aa, Artificial Sequence
  Description of Artificial Sequence: Synthetic polypeptide
GSSPSASTGTGPGTPGSGTASSSPGSSTPSGATGSPGTPGSGTASSSPGSSTPSGATGSPGSSTPSGATGSPGSSPSASTGTGPGSSPSASTGTGPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGSSPSASTGTGPGASPGTSSTGSPGASPGTSSTGSPGASPGTSSTGSPGASPGTSSTGSPGTPGSGTASSSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASPGTSSTGSPGTPGSGTASSSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSPSASTGTGPGSSTPSGATGSPGSSTPSGATGSPGASPGTSSTGSPGSSPSASTGTGPGTPGSGTASSSPGASPGTSSTGSPGSSPSASTGTGPGTPGSGTASSSPGSSPSASTGTGPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSPSASTGTGPGSSPSASTGTGPGASPGTSSTGSPGSSTPSGATGSPGASPGTSSTGSPGTPGSGTASSSPGTPGSGTASSSPGSSPSASTGTGPGASPGTSSTGSPGSSTPSGATGSPGSSPSASTGTGPGSSPSASTGTGPGASPGTSSTGSPGTPGSGTASSSPGSSTPSGATGSPGTPGSGTASSSPGSSPSASTGTGPGSSPSASTGTGPGASP

SEQ ID NO: 123 - protein, 72 aa, Artificial Sequence
  Description of Artificial Sequence: Synthetic polypeptide
SPAGSPTSTEEGSPAGSPTSTEEGTSESATPESGPGTSTEPSEGSAPGTSESATPESGPGSEPATSGSETPG

SEQ ID NO: 124 - protein, 72 aa, Artificial Sequence
  Description of Artificial Sequence: Synthetic polypeptide
TSESATPESGPGTSESATPESGPGSEPATSGSETPGSEPATSGSETPGSPAGSPTSTEEGTSTEPSEGSAPG

SEQ ID NO: 125 - protein, 108 aa, Artificial Sequence
  Description of Artificial Sequence: Synthetic polypeptide
TEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTS

SEQ ID NO: 126 - protein, 108 aa, Artificial Sequence
  Description of Artificial Sequence: Synthetic polypeptide
GSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 127 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 128 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 129 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 130 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 131 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 132 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 133 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 134 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 135 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 136 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 137 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 138 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 139 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 140 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 141 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 142 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 143 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 144 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 145 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 146 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 147 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 148 - protein, 72 aa, Artificial Sequence
  Description of Artificial Sequence: Synthetic polypeptide
GPGSSPSASTGTGPGTPGSGTASSSPGSSTPSGATGSPGSSPSASTGTGPGASPGTSSTGSPGTPGSGTASS

SEQ ID NO: 149 - protein, 72 aa, Artificial Sequence
  Description of Artificial Sequence: Synthetic polypeptide
GSSTPSGATGSPGSSTPSGATGSPGSSPSASTGTGPGSSPSASTGTGPGASPGTSSTGSPGTPGSGTASSSP

SEQ ID NO: 150 - protein, 72 aa, Artificial Sequence
  Description of Artificial Sequence: Synthetic polypeptide
SPSASTGTGPGASPGTSSTGSPGSSPSASTGTGPGTPGSGTASSSPGSSTPSGATGSPGSSTPSGATGSPGA

SEQ ID NO: 151 - protein, 108 aa, Artificial Sequence
  Description of Artificial Sequence: Synthetic polypeptide
SASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASP

SEQ ID NO: 152 - protein, 108 aa, Artificial Sequence
  Description of Artificial Sequence: Synthetic polypeptide
PGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSS

SEQ ID NO: 153 - protein, 144 aa, Artificial Sequence; identical to SEQ ID NO: 71
  Description of Artificial Sequence: Synthetic polypeptide

SEQ ID NO: 154 - protein, 144 aa, Artificial Sequence
  Description of Artificial Sequence: Synthetic polypeptide
PSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASP

SEQ ID NO: 155 - protein, 180 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGS

SEQ ID NO: 156 - protein, 216 aa, Artificial Sequence
  Description of Artificial Sequence: Synthetic polypeptide
TGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSG

SEQ ID NO: 157 - protein, 252 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPG

SEQ ID NO: 158 - protein, 288 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGS

SEQ ID NO: 159 - protein, 324 aa, Artificial Sequence
  Description of Artificial Sequence: Synthetic polypeptide
TSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 160 - protein, 360 aa, Artificial Sequence
  Description of Artificial Sequence: Synthetic polypeptide
TSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 161 - protein, 396 aa, Artificial Sequence
  Description of Artificial Sequence: Synthetic polypeptide
GATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGT

SEQ ID NO: 162 - protein, 432 aa, Artificial Sequence
  Description of Artificial Sequence: Synthetic polypeptide
GATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPS

SEQ ID NO: 163 - protein, 468 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 164 - protein, 504 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 165 - protein, 540 aa, Artificial Sequence
  Description of Artificial Sequence: Synthetic polypeptide
TSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 166 - protein, 576 aa, Artificial Sequence
  Description of Artificial Sequence: Synthetic polypeptide
TSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 167 - protein, 612 aa, Artificial Sequence
  Description of Artificial Sequence: Synthetic polypeptide
STGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTS

SEQ ID NO: 168 - protein, 648 aa, Artificial Sequence
  Description of Artificial Sequence: Synthetic polypeptide
GTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 169 - protein, 684 aa, Artificial Sequence
  Description of Artificial Sequence: Synthetic polypeptide
TSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 170 - protein, 720 aa, Artificial Sequence
  Description of Artificial Sequence: Synthetic polypeptide
TSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 171 - protein, 756 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPG

SEQ ID NO: 172 - protein, 792 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 173 - protein, 828 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 174 - protein, 4 aa, Artificial Sequence
  Description of Artificial Sequence: Synthetic peptide
GSPG

SEQ ID NO: 175 - protein, 4 aa, Artificial Sequence
  Description of Artificial Sequence: Synthetic peptide
ETET

SEQ ID NO: 176 - protein, 5 aa, Artificial Sequence
  Description of Artificial Sequence: Synthetic peptide
PGSSS

SEQ ID NO: 177 - protein, 5 aa, Artificial Sequence
  Description of Artificial Sequence: Synthetic peptide
GPSGP

SEQ ID NO: 178 - protein, 10 aa, Artificial Sequence
  Description of Artificial Sequence: Synthetic peptide
GAGSPGAETA

SEQ ID NO: 179 - protein, 7 aa, Artificial Sequence
  Description of Artificial Sequence: Synthetic peptide
KLTRAET

SEQ ID NO: 180 - protein, 7 aa, Artificial Sequence
  Description of Artificial Sequence: Synthetic peptide
DFTRVVG

SEQ ID NO: 181 - protein, 8 aa, Artificial Sequence
  Description of Artificial Sequence: Synthetic peptide
TMTRIVGG

SEQ ID NO: 182 - protein, 8 aa, Artificial Sequence
  Description of Artificial Sequence: Synthetic peptide
SPFRSTGG

SEQ ID NO: 183 - protein, 8 aa, Artificial Sequence
  Description of Artificial Sequence: Synthetic peptide
LQVRIVGG

SEQ ID NO: 184 - protein, 8 aa, Artificial Sequence
  Description of Artificial Sequence: Synthetic peptide
PLGRIVGG

SEQ ID NO: 185 - protein, 8 aa, Artificial Sequence
  Description of Artificial Sequence: Synthetic peptide
IEGRTVGG

SEQ ID NO: 186 - protein, 8 aa, Artificial Sequence
  Description of Artificial Sequence: Synthetic peptide
LTPRSLLV

SEQ ID NO: 187 - protein, 8 aa, Artificial Sequence
  Description of Artificial Sequence: Synthetic peptide
LGPVSGVP

SEQ ID NO: 188 - protein, 8 aa, Artificial Sequence
  Description of Artificial Sequence: Synthetic peptide
VAGDSLEE

SEQ ID NO: 189 - protein, 8 aa, Artificial Sequence
  Description of Artificial Sequence: Synthetic peptide
GPAGLGGA

SEQ ID NO: 190 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 191 - protein, 8 aa, Artificial Sequence
  Description of Artificial Sequence: Synthetic peptide
GPAGLRGA

SEQ ID NO: 192 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 193 - protein, 8 aa, Artificial Sequence
  Description of Artificial Sequence: Synthetic peptide
APLGLRLR

SEQ ID NO: 194 - protein, 8 aa, Artificial Sequence
  Description of Artificial Sequence: Synthetic peptide
PALPLVAQ

SEQ ID NO: 195 - protein, 7 aa, Artificial Sequence
  Description of Artificial Sequence: Synthetic peptide
ENLYFQG

SEQ ID NO: 196 - protein, 8 aa, Artificial Sequence
  Description of Artificial Sequence: Synthetic peptide
ENLYFQGS

SEQ ID NO: 197 - protein, 8 aa, Artificial Sequence
  Description of Artificial Sequence: Synthetic peptide
DDDKIVGG

SEQ ID NO: 198 - protein, 8 aa, Artificial Sequence
  Description of Artificial Sequence: Synthetic peptide
DDDKIVGG

SEQ ID NO: 199 - protein, 8 aa, Artificial Sequence
  Description of Artificial Sequence: Synthetic peptide
LEVLFQGP

SEQ ID NO: 200 - protein, 8 aa, Artificial Sequence
  Description of Artificial Sequence: Synthetic peptide
LEVLFQGP

SEQ ID NO: 201 - protein, 8 aa, Artificial Sequence
  Description of Artificial Sequence: Synthetic peptide
LPKTGSES

SEQ ID NO: 202 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 203 - protein, 36 aa, Artificial Sequence
  Description of Artificial Sequence: Synthetic polypeptide
GSGGEPSESGSSGESPGGSSGSESGESPGGSSGSES

SEQ ID NO: 204 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 205 - protein, 36 aa, Artificial Sequence
  Description of Artificial Sequence: Synthetic polypeptide
GSEGSSGPGESSGESPGGSSGSESGSSESGSSEGGP

SEQ ID NO: 206 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 207 - protein, 36 aa, Artificial Sequence
  Description of Artificial Sequence: Synthetic polypeptide
GSSESGSSEGGPGSSESGSSEGGPGESPGGSSGSES

SEQ ID NO: 208 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 209 - protein, 36 aa, Artificial Sequence
  Description of Artificial Sequence: Synthetic polypeptide
GSGGEPSESGSSGSSESGSSEGGPGSGGEPSESGSS

SEQ ID NO: 210 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 211 - protein, 36 aa, Artificial Sequence
  Description of Artificial Sequence: Synthetic polypeptide
GSSESGSSEGGPGSEGSSGPGESSGSEGSSGPGESS

SEQ ID NO: 212 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 213 - protein, 36 aa, Artificial Sequence
  Description of Artificial Sequence: Synthetic polypeptide
GSSESGSSEGGPGESPGGSSGSESGSEGSSGPGESS

SEQ ID NO: 214 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 215 - protein, 36 aa, Artificial Sequence
  Description of Artificial Sequence: Synthetic polypeptide
GSGGEPSESGSSGSGGEPSESGSSGSEGSSGPGESS

SEQ ID NO: 216 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 217 - protein, 36 aa, Artificial Sequence
  Description of Artificial Sequence: Synthetic polypeptide
GSSESGSSEGGPGSEGSSGPGESSGESPGGSSGSES

SEQ ID NO: 218 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 219 - protein, 36 aa, Artificial Sequence
  Description of Artificial Sequence: Synthetic polypeptide
GSSESGSSEGGPGSSESGSSEGGPGSSESGSSEGGP

SEQ ID NO: 220 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 221 - protein, 36 aa, Artificial Sequence
  Description of Artificial Sequence: Synthetic polypeptide
GSGGEPSESGSSGSEGSSGPGESSGSSESGSSEGGP

SEQ ID NO: 222 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 223 - protein, 36 aa, Artificial Sequence; identical to SEQ ID NO: 209
  Description of Artificial Sequence: Synthetic polypeptide

SEQ ID NO: 224 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 225 - protein, 36 aa, Artificial Sequence
  Description of Artificial Sequence: Synthetic polypeptide
GSGGEPSESGSSGSSESGSSEGGPGESPGGSSGSES

SEQ ID NO: 226 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 227 - protein, 36 aa, Artificial Sequence
  Description of Artificial Sequence: Synthetic polypeptide
GSGGEPSESGSSGESPGGSSGSESGSEGSSGPGESS

SEQ ID NO: 228 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 229 - protein, 36 aa, Artificial Sequence
  Description of Artificial Sequence: Synthetic polypeptide
GSGGEPSESGSSGESPGGSSGSESGSGGEPSESGSS

SEQ ID NO: 230 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 231 - protein, 36 aa, Artificial Sequence; identical to SEQ ID NO: 219
  Description of Artificial Sequence: Synthetic polypeptide

SEQ ID NO: 232 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 233 - protein, 36 aa, Artificial Sequence
  Description of Artificial Sequence: Synthetic polypeptide
GESPGGSSGSESGSEGSSGPGESSGSEGSSGPGESS

SEQ ID NO: 234 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 235 - protein, 36 aa, Artificial Sequence
  Description of Artificial Sequence: Synthetic polypeptide
GSGGEPSESGSSGSGGEPSESGSSGSSESGSSEGGP

SEQ ID NO: 236 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 237 - protein, 36 aa, Artificial Sequence
  Description of Artificial Sequence: Synthetic polypeptide
GSGGEPSESGSSGSGGEPSESGSSGSGGEPSESGSS

SEQ ID NO: 238 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 239 - protein, 36 aa, Artificial Sequence
  Description of Artificial Sequence: Synthetic polypeptide
GSGGEPSESGSSGSSESGSSEGGPGSEGSSGPGESS

SEQ ID NO: 240 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 241 - protein, 36 aa, Artificial Sequence
  Description of Artificial Sequence: Synthetic polypeptide
GSGGEPSESGSSGSEGSSGPGESSGSGGEPSESGSS

SEQ ID NO: 242 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 243 - protein, 36 aa, Artificial Sequence; identical to SEQ ID NO: 229
  Description of Artificial Sequence: Synthetic polypeptide

SEQ ID NO: 244 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 245 - protein, 36 aa, Artificial Sequence
  Description of Artificial Sequence: Synthetic polypeptide
GSSESGSSEGGPGSGGEPSESGSSGSSESGSSEGGP

SEQ ID NO: 246 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 247 - protein, 36 aa, Artificial Sequence
  Description of Artificial Sequence: Synthetic polypeptide
GSEGSSGPGESSGESPGGSSGSESGSEGSSGPGESS

SEQ ID NO: 248 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 249 - protein, 36 aa, Artificial Sequence; identical to SEQ ID NO: 219
  Description of Artificial Sequence: Synthetic polypeptide

SEQ ID NO: 250 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 251 - protein, 36 aa, Artificial Sequence; identical to SEQ ID NO: 203
  Description of Artificial Sequence: Synthetic polypeptide

SEQ ID NO: 252 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 253 - protein, 36 aa, Artificial Sequence
  Description of Artificial Sequence: Synthetic polypeptide
GSGGEPSESGSSGSEGSSGPGESSGESPGGSSGSES

SEQ ID NO: 254 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 255 - protein, 36 aa, Artificial Sequence
  Description of Artificial Sequence: Synthetic polypeptide
GESPGGSSGSESGESPGGSSGSESGESPGGSSGSES

SEQ ID NO: 256 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 257 - protein, 36 aa, Artificial Sequence
  Description of Artificial Sequence: Synthetic polypeptide
GSEGSSGPGESSGSEGSSGPGESSGSGGEPSESGSS

SEQ ID NO: 258 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 259 - protein, 36 aa, Artificial Sequence; identical to SEQ ID NO: 253
  Description of Artificial Sequence: Synthetic polypeptide

SEQ ID NO: 260 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 261 - protein, 36 aa, Artificial Sequence; identical to SEQ ID NO: 209
  Description of Artificial Sequence: Synthetic polypeptide

SEQ ID NO: 262 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 263 - protein, 36 aa, Artificial Sequence
  Description of Artificial Sequence: Synthetic polypeptide
GSSESGSSEGGPGSGGEPSESGSSGSEGSSGPGESS

SEQ ID NO: 264 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 265 - protein, 36 aa, Artificial Sequence
  Description of Artificial Sequence: Synthetic polypeptide
GSGGEPSESGSSGSEGSSGPGESSGSEGSSGPGESS

SEQ ID NO: 266 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 267 - protein, 36 aa, Artificial Sequence; identical to SEQ ID NO: 209
  Description of Artificial Sequence: Synthetic polypeptide

SEQ ID NO: 268 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 269 - protein, 36 aa, Artificial Sequence; identical to SEQ ID NO: 203
  Description of Artificial Sequence: Synthetic polypeptide

SEQ ID NO: 270 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 271 - protein, 36 aa, Artificial Sequence
  Description of Artificial Sequence: Synthetic polypeptide
GSGGEPSESGSSGSGGEPSESGSSGESPGGSSGSES

SEQ ID NO: 272 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 273 - protein, 36 aa, Artificial Sequence
  Description of Artificial Sequence: Synthetic polypeptide
GSEGSSGPGESSGSSESGSSEGGPGSEGSSGPGESS

SEQ ID NO: 274 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 275 - protein, 36 aa, Artificial Sequence
  Description of Artificial Sequence: Synthetic polypeptide
GSSESGSSEGGPGESPGGSSGSESGESPGGSSGSES

SEQ ID NO: 276 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 277 - protein, 36 aa, Artificial Sequence; identical to SEQ ID NO: 257
  Description of Artificial Sequence: Synthetic polypeptide

SEQ ID NO: 278 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 279 - protein, 36 aa, Artificial Sequence
  Description of Artificial Sequence: Synthetic polypeptide
GSPAGSPTSTEEGTSESATPESGPGTSTEPSEGSAP

SEQ ID NO: 280 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 281 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 282 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 283 - protein, 36 aa, Artificial Sequence
  Description of Artificial Sequence: Synthetic polypeptide
GTSTEPSEGSAPGTSESATPESGPGTSESATPESGP

SEQ ID NO: 284 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 285 - protein, 36 aa, Artificial Sequence; identical to SEQ ID NO: 283
  Description of Artificial Sequence: Synthetic polypeptide

SEQ ID NO: 286 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 287 - protein, 36 aa, Artificial Sequence
  Description of Artificial Sequence: Synthetic polypeptide
GSEPATSGSETPGTSESATPESGPGSPAGSPTSTEE

SEQ ID NO: 288 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 289 - protein, 36 aa, Artificial Sequence
  Description of Artificial Sequence: Synthetic polypeptide
GTSESATPESGPGSEPATSGSETPGTSTEPSEGSAP

SEQ ID NO: 290 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 291 - protein, 36 aa, Artificial Sequence
  Description of Artificial Sequence: Synthetic polypeptide
GSPAGSPTSTEEGSPAGSPTSTEEGSEPATSGSETP

SEQ ID NO: 292 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 293 - protein, 36 aa, Artificial Sequence; identical to SEQ ID NO: 279
  Description of Artificial Sequence: Synthetic polypeptide

SEQ ID NO: 294 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 295 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 296 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 297 - protein, 36 aa, Artificial Sequence
  Description of Artificial Sequence: Synthetic polypeptide
GTSESATPESGPGTSTEPSEGSAPGTSTEPSEGSAP

SEQ ID NO: 298 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 299 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 300 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 301 - protein, 36 aa, Artificial Sequence
  Description of Artificial Sequence: Synthetic polypeptide
GSEPATSGSETPGSPAGSPTSTEEGTSESATPESGP

SEQ ID NO: 302 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 303 - protein, 36 aa, Artificial Sequence; identical to SEQ ID NO: 283
  Description of Artificial Sequence: Synthetic polypeptide

SEQ ID NO: 304 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 305 - protein, 36 aa, Artificial Sequence
  Description of Artificial Sequence: Synthetic polypeptide
GTSTEPSEGSAPGSEPATSGSETPGSPAGSPTSTEE

SEQ ID NO: 306 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 307 - protein, 36 aa, Artificial Sequence
  Description of Artificial Sequence: Synthetic polypeptide
GSPAGSPTSTEEGTSESATPESGPGSEPATSGSETP

SEQ ID NO: 308 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 309 - protein, 36 aa, Artificial Sequence
  Description of Artificial Sequence: Synthetic polypeptide
GTSESATPESGPGSPAGSPTSTEEGSPAGSPTSTEE

SEQ ID NO: 310 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 311 - protein, 36 aa, Artificial Sequence
  Description of Artificial Sequence: Synthetic polypeptide
GTSTEPSEGSAPGTSESATPESGPGTSTEPSEGSAP

SEQ ID NO: 312 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 313 - protein, 36 aa, Artificial Sequence
  Description of Artificial Sequence: Synthetic polypeptide
GSPAGSPTSTEEGTSTEPSEGSAPGSEPATSGSETP

SEQ ID NO: 314 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 315 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 316 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 317 - protein, 36 aa, Artificial Sequence; identical to SEQ ID NO: 287
  Description of Artificial Sequence: Synthetic polypeptide

SEQ ID NO: 318 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 319 - protein, 36 aa, Artificial Sequence; identical to SEQ ID NO: 297
  Description of Artificial Sequence: Synthetic polypeptide

SEQ ID NO: 320 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 321 - protein, 36 aa, Artificial Sequence; identical to SEQ ID NO: 315
  Description of Artificial Sequence: Synthetic polypeptide

SEQ ID NO: 322 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 323 - protein, 36 aa, Artificial Sequence; identical to SEQ ID NO: 281
  Description of Artificial Sequence: Synthetic polypeptide

SEQ ID NO: 324 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 325 - protein, 36 aa, Artificial Sequence
  Description of Artificial Sequence: Synthetic polypeptide
GSEPATSGSETPGTSESATPESGPGTSTEPSEGSAP

SEQ ID NO: 326 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 327 - protein, 36 aa, Artificial Sequence; identical to SEQ ID NO: 299
  Description of Artificial Sequence: Synthetic polypeptide

SEQ ID NO: 328 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 329 - protein, 36 aa, Artificial Sequence
  Description of Artificial Sequence: Synthetic polypeptide
GSEPATSGSETPGTSESATPESGPGSEPATSGSETP

SEQ ID NO: 330 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 331 - protein, 36 aa, Artificial Sequence; identical to SEQ ID NO: 329
  Description of Artificial Sequence: Synthetic polypeptide

SEQ ID NO: 332 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 333 - protein, 36 aa, Artificial Sequence
  Description of Artificial Sequence: Synthetic polypeptide
GSEPATSGSETPGSEPATSGSETPGTSTEPSEGSAP

SEQ ID NO: 334 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 335 - protein, 36 aa, Artificial Sequence
  Description of Artificial Sequence: Synthetic polypeptide
GTSESATPESGPGSEPATSGSETPGSEPATSGSETP

SEQ ID NO: 336 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 337 - protein, 36 aa, Artificial Sequence
  Description of Artificial Sequence: Synthetic polypeptide
GTSTEPSEGSAPGTSTEPSEGSAPGTSESATPESGP

SEQ ID NO: 338 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 339 - protein, 36 aa, Artificial Sequence
  Description of Artificial Sequence: Synthetic polypeptide
GSEPATSGSETPGTSESATPESGPGTSESATPESGP

SEQ ID NO: 340 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 341 - protein, 36 aa, Artificial Sequence; identical to SEQ ID NO: 333
  Description of Artificial Sequence: Synthetic polypeptide

SEQ ID NO: 342 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 343 - protein, 36 aa, Artificial Sequence
  Description of Artificial Sequence: Synthetic polypeptide
GSEPATSGSETPGTSTEPSEGSAPGSEPATSGSETP

SEQ ID NO: 344 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 345 - protein, 36 aa, Artificial Sequence
  Description of Artificial Sequence: Synthetic polypeptide
GTSTEPSEGSAPGTSTEPSEGSAPGSEPATSGSETP

SEQ ID NO: 346 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 347 - protein, 36 aa, Artificial Sequence; identical to SEQ ID NO: 305
  Description of Artificial Sequence: Synthetic polypeptide

SEQ ID NO: 348 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 349 - protein, 36 aa, Artificial Sequence; identical to SEQ ID NO: 301
  Description of Artificial Sequence: Synthetic polypeptide

SEQ ID NO: 350 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 351 - protein, 36 aa, Artificial Sequence
  Description of Artificial Sequence: Synthetic polypeptide
GTSESATPESGPGSEPATSGSETPGTSESATPESGP

SEQ ID NO: 352 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 353 - protein, 36 aa, Artificial Sequence
  Description of Artificial Sequence: Synthetic polypeptide
GTSTPESGSASPGTSPSGESSTAPGTSPSGESSTAP

SEQ ID NO: 354 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 355 - protein, 36 aa, Artificial Sequence
  Description of Artificial Sequence: Synthetic polypeptide
GTSPSGESSTAPGSTSSTAESPGPGTSPSGESSTAP

SEQ ID NO: 356 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 357 - protein, 36 aa, Artificial Sequence
  Description of Artificial Sequence: Synthetic polypeptide
GSTSSTAESPGPGTSPSGESSTAPGTSTPESGSASP

SEQ ID NO: 358 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 359 - protein, 36 aa, Artificial Sequence
  Description of Artificial Sequence: Synthetic polypeptide
GSTSSTAESPGPGSTSSTAESPGPGTSPSGESSTAP

SEQ ID NO: 360 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 361 - protein, 36 aa, Artificial Sequence; identical to SEQ ID NO: 357
  Description of Artificial Sequence: Synthetic polypeptide

SEQ ID NO: 362 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 363 - protein, 36 aa, Artificial Sequence
  Description of Artificial Sequence: Synthetic polypeptide
GSTSSTAESPGPGTSTPESGSASPGSTSESPSGTAP

SEQ ID NO: 364 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 365 - protein, 36 aa, Artificial Sequence
  Description of Artificial Sequence: Synthetic polypeptide
GSTSSTAESPGPGTSTPESGSASPGTSTPESGSASP

SEQ ID NO: 366 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 367 - protein, 36 aa, Artificial Sequence
  Description of Artificial Sequence: Synthetic polypeptide
GSTSESPSGTAPGTSPSGESSTAPGSTSESPSGTAP

SEQ ID NO: 368 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 369 - protein, 36 aa, Artificial Sequence; identical to SEQ ID NO: 359
  Description of Artificial Sequence: Synthetic polypeptide

SEQ ID NO: 370 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 371 - protein, 36 aa, Artificial Sequence; identical to SEQ ID NO: 363
  Description of Artificial Sequence: Synthetic polypeptide

SEQ ID NO: 372 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 373 - protein, 36 aa, Artificial Sequence; identical to SEQ ID NO: 359
  Description of Artificial Sequence: Synthetic polypeptide

SEQ ID NO: 374 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 375 - protein, 36 aa, Artificial Sequence
  Description of Artificial Sequence: Synthetic polypeptide
GSTSSTAESPGPGSTSESPSGTAPGSTSSTAESPGP

SEQ ID NO: 376 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 377 - protein, 36 aa, Artificial Sequence
  Description of Artificial Sequence: Synthetic polypeptide
GSTSSTAESPGPGSTSSTAESPGPGSTSSTAESPGP

SEQ ID NO: 378 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 379 - protein, 36 aa, Artificial Sequence
  Description of Artificial Sequence: Synthetic polypeptide
GSTSESPSGTAPGSTSSTAESPGPGSTSSTAESPGP

SEQ ID NO: 380 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 381 - protein, 36 aa, Artificial Sequence
  Description of Artificial Sequence: Synthetic polypeptide
GSTSESPSGTAPGSTSESPSGTAPGSTSESPSGTAP

SEQ ID NO: 382 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 383 - protein, 36 aa, Artificial Sequence; identical to SEQ ID NO: 377
  Description of Artificial Sequence: Synthetic polypeptide

SEQ ID NO: 384 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 385 - protein, 36 aa, Artificial Sequence; identical to SEQ ID NO: 359
  Description of Artificial Sequence: Synthetic polypeptide

SEQ ID NO: 386 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 387 - protein, 36 aa, Artificial Sequence
  Description of Artificial Sequence: Synthetic polypeptide
GSSPSASTGTGPGSSTPSGATGSPGSSTPSGATGSP

SEQ ID NO: 388 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 389 - protein, 36 aa, Artificial Sequence
  Description of Artificial Sequence: Synthetic polypeptide
GTSPSGESSTAPGTSTPESGSASPGSTSSTAESPGP

SEQ ID NO: 390 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 391 - protein, 36 aa, Artificial Sequence
  Description of Artificial Sequence: Synthetic polypeptide
GSTSSTAESPGPGSTSSTAESPGPGTSTPESGSASP

SEQ ID NO: 392 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 393 - protein, 36 aa, Artificial Sequence
  Description of Artificial Sequence: Synthetic polypeptide
GTSPSGESSTAPGSTSSTAESPGPGTSTPESGSASP

SEQ ID NO: 394 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 395 - protein, 36 aa, Artificial Sequence; identical to SEQ ID NO: 379
  Description of Artificial Sequence: Synthetic polypeptide

SEQ ID NO: 396 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 397 - protein, 36 aa, Artificial Sequence; identical to SEQ ID NO: 375
  Description of Artificial Sequence: Synthetic polypeptide

SEQ ID NO: 398 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 399 - protein, 36 aa, Artificial Sequence; identical to SEQ ID NO: 357
  Description of Artificial Sequence: Synthetic polypeptide

SEQ ID NO: 400 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 401 - protein, 36 aa, Artificial Sequence
  Description of Artificial Sequence: Synthetic polypeptide
GSTSESPSGTAPGSTSESPSGTAPGTSPSGESSTAP

SEQ ID NO: 402 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 403 - protein, 36 aa, Artificial Sequence
  Description of Artificial Sequence: Synthetic polypeptide
GSTSESPSGTAPGSTSESPSGTAPGTSTPESGSASP

SEQ ID NO: 404 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 405 - protein, 36 aa, Artificial Sequence
  Description of Artificial Sequence: Synthetic polypeptide
GTSTPESGSASPGSTSSTAESPGPGSTSSTAESPGP

SEQ ID NO: 406 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 407 - protein, 36 aa, Artificial Sequence; identical to SEQ ID NO: 401
  Description of Artificial Sequence: Synthetic polypeptide

SEQ ID NO: 408 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 409 - protein, 36 aa, Artificial Sequence
  Description of Artificial Sequence: Synthetic polypeptide
GSTSSTAESPGPGSTSSTAESPGPGSTSESPSGTAP

SEQ ID NO: 410 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 411 - protein, 36 aa, Artificial Sequence; identical to SEQ ID NO: 391
  Description of Artificial Sequence: Synthetic polypeptide

SEQ ID NO: 412 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 413 - protein, 36 aa, Artificial Sequence; identical to SEQ ID NO: 409
  Description of Artificial Sequence: Synthetic polypeptide

SEQ ID NO: 414 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 415 - protein, 36 aa, Artificial Sequence
  Description of Artificial Sequence: Synthetic polypeptide
GTSPSGESSTAPGSTSESPSGTAPGSTSSTAESPGP

SEQ ID NO: 416 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 417 - protein, 36 aa, Artificial Sequence
  Description of Artificial Sequence: Synthetic polypeptide
GSTSESPSGTAPGTSPSGESSTAPGSTSSTAESPGP

SEQ ID NO: 418 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 419 - protein, 36 aa, Artificial Sequence
  Description of Artificial Sequence: Synthetic polypeptide
GSTSSTAESPGPGSTSESPSGTAPGTSPSGESSTAP

SEQ ID NO: 420 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 421 - protein, 36 aa, Artificial Sequence; identical to SEQ ID NO: 403
  Description of Artificial Sequence: Synthetic polypeptide

SEQ ID NO: 422 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 423 - protein, 36 aa, Artificial Sequence
  Description of Artificial Sequence: Synthetic polypeptide
GTSTPESGSASPGSTSESPSGTAPGSTSSTAESPGP

SEQ ID NO: 424 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 425 - protein, 36 aa, Artificial Sequence
  Description of Artificial Sequence: Synthetic polypeptide
GSTSSTAESPGPGTSPSGESSTAPGTSPSGESSTAP

SEQ ID NO: 426 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 427 - protein, 36 aa, Artificial Sequence
  Description of Artificial Sequence: Synthetic polypeptide
GTSPSGESSTAPGTSPSGESSTAPGTSPSGESSTAP

SEQ ID NO: 428 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 429 - protein, 36 aa, Artificial Sequence; identical to SEQ ID NO: 363
  Description of Artificial Sequence: Synthetic polypeptide

SEQ ID NO: 430 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 431 - protein, 36 aa, Artificial Sequence
  Description of Artificial Sequence: Synthetic polypeptide
GSTSESPSGTAPGTSPSGESSTAPGTSPSGESSTAP

SEQ ID NO: 432 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 433 - protein, 36 aa, Artificial Sequence
  Description of Artificial Sequence: Synthetic polypeptide
GSTSESPSGTAPGTSTPESGSASPGSTSSTAESPGP

SEQ ID NO: 434 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 435 - protein, 36 aa, Artificial Sequence; identical to SEQ ID NO: 409
  Description of Artificial Sequence: Synthetic polypeptide

SEQ ID NO: 436 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 437 - protein, 36 aa, Artificial Sequence
  Description of Artificial Sequence: Synthetic polypeptide
GSTSESPSGTAPGTSTPESGSASPGTSTPESGSASP

SEQ ID NO: 438 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 439 - protein, 36 aa, Artificial Sequence; identical to SEQ ID NO: 437
  Description of Artificial Sequence: Synthetic polypeptide

SEQ ID NO: 440 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 441 - protein, 36 aa, Artificial Sequence
  Description of Artificial Sequence: Synthetic polypeptide
GASPGTSSTGSPGTPGSGTASSSPGSSTPSGATGSP

SEQ ID NO: 442 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 443 - protein, 36 aa, Artificial Sequence
  Description of Artificial Sequence: Synthetic polypeptide
GSSTPSGATGSPGSSPSASTGTGPGSSTPSGATGSP

SEQ ID NO: 444 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 445 - protein, 36 aa, Artificial Sequence
  Description of Artificial Sequence: Synthetic polypeptide
GASPGTSSTGSPGSSPSASTGTGPGSSTPSGATGSP

SEQ ID NO: 446 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 447 - protein, 36 aa, Artificial Sequence
  Description of Artificial Sequence: Synthetic polypeptide
GTPGSGTASSSPGSSTPSGATGSPGASPGTSSTGSP

SEQ ID NO: 448 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 449 - protein, 36 aa, Artificial Sequence
  Description of Artificial Sequence: Synthetic polypeptide
GTPGSGTASSSPGASPGTSSTGSPGSRPSASTGTGP

SEQ ID NO: 450 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 451 - protein, 36 aa, Artificial Sequence
  Description of Artificial Sequence: Synthetic polypeptide
GASPGTSSTGSPGSSTPSGATGSPGASPGTSSTGSP

SEQ ID NO: 452 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 453 - protein, 36 aa, Artificial Sequence
  Description of Artificial Sequence: Synthetic polypeptide
GTPGSGTASSSPGSSTPSGATGSPGSSTPSGATGSP

SEQ ID NO: 454 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 455 - protein, 36 aa, Artificial Sequence
  Description of Artificial Sequence: Synthetic polypeptide
GASPGTSSTGSPGASPGTSSTGSPGASPGTSSTGSP

SEQ ID NO: 456 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 457 - protein, 36 aa, Artificial Sequence
  Description of Artificial Sequence: Synthetic polypeptide
GSSTPSGATGSPGSSPSASTGTGPGASPGTSSTGSP

SEQ ID NO: 458 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 459 - protein, 36 aa, Artificial Sequence
  Description of Artificial Sequence: Synthetic polypeptide
GSSTPSGATGSPGSSTPSGATGSPGTPGSGTASSSP

SEQ ID NO: 460 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 461 - protein, 36 aa, Artificial Sequence
  Description of Artificial Sequence: Synthetic polypeptide
GSSTPSGATGSPGSSTPSGATGSPGASPGTSSTGSP

SEQ ID NO: 462 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 463 - protein, 36 aa, Artificial Sequence
  Description of Artificial Sequence: Synthetic polypeptide
GTPGSGTASSSPGSSPSASTGTGPGSSTPSGATGSP

SEQ ID NO: 464 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 465 - protein, 36 aa, Artificial Sequence
  Description of Artificial Sequence: Synthetic polypeptide
GASPGTSSTGSPGSSPSASTGTGPGTPGSGTASSSP

SEQ ID NO: 466 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 467 - protein, 36 aa, Artificial Sequence; identical to SEQ ID NO: 461
  Description of Artificial Sequence: Synthetic polypeptide

SEQ ID NO: 468 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 469 - protein, 36 aa, Artificial Sequence
  Description of Artificial Sequence: Synthetic polypeptide
GTPGSGTASSSPGSSTPSGATGSPGSSPSASTGTGP

SEQ ID NO: 470 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 471 - protein, 36 aa, Artificial Sequence
  Description of Artificial Sequence: Synthetic polypeptide
GSSTPSGATGSPGTPGSGTASSSPGTPGSGTASSSP

SEQ ID NO: 472 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 473 - protein, 36 aa, Artificial Sequence; identical to SEQ ID NO: 447
  Description of Artificial Sequence: Synthetic polypeptide

SEQ ID NO: 474 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 475 - protein, 36 aa, Artificial Sequence; identical to SEQ ID NO: 461
  Description of Artificial Sequence: Synthetic polypeptide

SEQ ID NO: 476 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 477 - protein, 36 aa, Artificial Sequence; identical to SEQ ID NO: 441
  Description of Artificial Sequence: Synthetic polypeptide

SEQ ID NO: 478 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 479 - protein, 36 aa, Artificial Sequence
  Description of Artificial Sequence: Synthetic polypeptide
GSSPSASTGTGPGSSTPSGATGSPGTPGSGTASSSP

SEQ ID NO: 480 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 481 - protein, 36 aa, Artificial Sequence; identical to SEQ ID NO: 445
  Description of Artificial Sequence: Synthetic polypeptide

SEQ ID NO: 482 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 483 - protein, 36 aa, Artificial Sequence
  Description of Artificial Sequence: Synthetic polypeptide
GASPGTSSTGSPGSSTPSGATGSPGSSTPSGATGSP

SEQ ID NO: 484 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 485 - protein, 36 aa, Artificial Sequence
  Description of Artificial Sequence: Synthetic polypeptide
GTPGSGTASSSPGSSTPSGATGSPGTPGSGTASSSP

SEQ ID NO: 486 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 487 - protein, 36 aa, Artificial Sequence; identical to SEQ ID NO: 387
  Description of Artificial Sequence: Synthetic polypeptide

SEQ ID NO: 488 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 489 - protein, 36 aa, Artificial Sequence
  Description of Artificial Sequence: Synthetic polypeptide
GASPGTSSTGSPGSSPSASTGTGPGSSPSASTGTGP

SEQ ID NO: 490 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 491 - protein, 36 aa, Artificial Sequence
  Description of Artificial Sequence: Synthetic polypeptide
GTPGSGTASSSPGASPGTSSTGSPGASPGTSSTGSP

SEQ ID NO: 492 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 493 - protein, 36 aa, Artificial Sequence
  Description of Artificial Sequence: Synthetic polypeptide
GSSTPSGATGSPGASPGTSSTGSPGSSTPSGATGSP

SEQ ID NO: 494 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 495 - protein, 36 aa, Artificial Sequence
  Description of Artificial Sequence: Synthetic polypeptide
GSSTPSGATGSPGTPGSGTASSSPGSSTPSGATGSP

SEQ ID NO: 496 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 497 - protein, 36 aa, Artificial Sequence; identical to SEQ ID NO: 445
  Description of Artificial Sequence: Synthetic polypeptide

SEQ ID NO: 498 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 499 - protein, 36 aa, Artificial Sequence
  Description of Artificial Sequence: Synthetic polypeptide
GSSTPSGATGSPGSSTPSGATGSPGSSTPSGATGSP

SEQ ID NO: 500 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 501 - protein, 36 aa, Artificial Sequence
  Description of Artificial Sequence: Synthetic polypeptide
GASPGTSSTGSPGTPGSGTASSSPGASPGTSSTGSP

SEQ ID NO: 502 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 503 - protein, 36 aa, Artificial Sequence; identical to SEQ ID NO: 457
  Description of Artificial Sequence: Synthetic polypeptide

SEQ ID NO: 504 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 505 - protein, 36 aa, Artificial Sequence
  Description of Artificial Sequence: Synthetic polypeptide
GASPGTSSTGSPGSSTPSGATGSPGSSPSASTGTGP

SEQ ID NO: 506 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 507 - protein, 36 aa, Artificial Sequence; identical to SEQ ID NO: 447
  Description of Artificial Sequence: Synthetic polypeptide

SEQ ID NO: 508 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 509 - protein, 36 aa, Artificial Sequence; identical to SEQ ID NO: 495
  Description of Artificial Sequence: Synthetic polypeptide

SEQ ID NO: 510 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 511 - protein, 36 aa, Artificial Sequence
  Description of Artificial Sequence: Synthetic polypeptide
GSSPSASTGTGPGSSPSASTGTGPGASPGTSSTGSP

SEQ ID NO: 512 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 513 - protein, 36 aa, Artificial Sequence
  Description of Artificial Sequence: Synthetic polypeptide
GTPGSGTASSSPGSSTPSGATGSPGSNPSASTGTGP

SEQ ID NO: 514 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 515 - protein, 36 aa, Artificial Sequence
  Description of Artificial Sequence: Synthetic polypeptide
GSSPSASTGTGPGSSTPSGATGSPGASPGTSSTGSP

SEQ ID NO: 516 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 517 - protein, 36 aa, Artificial Sequence
  Description of Artificial Sequence: Synthetic polypeptide
GSSTPSGATGSPGASPGTSSTGSPGTPGSGTASSSP

SEQ ID NO: 518 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 519 - protein, 36 aa, Artificial Sequence; identical to SEQ ID NO: 499
  Description of Artificial Sequence: Synthetic polypeptide

SEQ ID NO: 520 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 521 - protein, 36 aa, Artificial Sequence; identical to SEQ ID NO: 441
  Description of Artificial Sequence: Synthetic polypeptide

SEQ ID NO: 522 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 523 - protein, 36 aa, Artificial Sequence
  Description of Artificial Sequence: Synthetic polypeptide
GSSTPSGATGSPGSSPSASTGTGPGSSPSASTGTGP

SEQ ID NO: 524 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 525 - protein, 36 aa, Artificial Sequence; identical to SEQ ID NO: 489
  Description of Artificial Sequence: Synthetic polypeptide

SEQ ID NO: 526 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 527 - protein, 36 aa, Artificial Sequence; identical to SEQ ID NO: 465
  Description of Artificial Sequence: Synthetic polypeptide

SEQ ID NO: 528 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 529 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 530 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 531 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 532 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 533 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 534 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 535 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 536 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 537 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 538 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 539 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 540 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 541 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 542 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 543 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 544 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 545 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 546 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 547 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 548 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 549 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 550 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 551 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 552 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 553 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 554 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 555 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 556 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 557 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 558 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 559 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 560 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 561 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 562 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 563 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 564 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 565 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 566 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 567 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 568 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 569 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 570 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 571 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 572 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 573 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 574 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 575 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 576 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 577 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 578 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 579 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 580 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 581 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 582 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 583 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 584 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 585 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 586 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 587 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 588 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 589 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 590 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 591 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 592 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 593 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 594 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 595 - protein, 1469 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 596 - DNA, 4410 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 597 - protein, 1511 aa, Artificial Sequence
  Description of Artificial Sequence: Synthetic polypeptide
ATRGAPGSPAGSPTSTEEGTSESATPESGPGSEPATSGSETPASSRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 598 - DNA, 4536 bp, Artificial Sequence
  Description of Artificial Sequence: Synthetic polynucleotide
gccaccagaggcgcgccaggttctcctgctggctcccccacctcaacagaagaggggacaagcgaaagcgctacgcctgagagtggccctggctctgagccagccacctccggctctgaaacccctgcctcgagcagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 599 - protein, 1514 aa, Artificial Sequence
  Description of Artificial Sequence: Synthetic polypeptide
ATRGAPGSPAGSPTSTEEGTSESATPESGPGSEPATSGSETPASSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 600 - DNA, 4545 bp, Artificial Sequence
  Description of Artificial Sequence: Synthetic polynucleotide
gccaccagaggcgcgccaggttctcctgctggctcccccacctcaacagaagaggggacaagcgaaagcgctacgcctgagagtggccctggctctgagccagccacctccggctctgaaacccctgcctcgagcgctacaagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 601 - protein, 1511 aa, Artificial Sequence
  Description of Artificial Sequence: Synthetic polypeptide
ATRRYYLGAVELSWDYMQGAPGSPAGSPTSTEEGTSESATPESGPGSEPATSGSETPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 602 - DNA, 4536 bp, Artificial Sequence
  Description of Artificial Sequence: Synthetic polynucleotide
gccaccagaagatactacctgggtgcagtggaactgtcatgggactatatgcaaggcgcgccaggttctcctgctggctcccccacctcaacagaagaggggacaagcgaaagcgctacgcctgagagtggccctggctctgagccagccacctccggctctgaaacccctgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 603 - protein, 1511 aa, Artificial Sequence
  Description of Artificial Sequence: Synthetic polypeptide
ATRRYYLGAVELSWDYMQSDLGGAPGSPAGSPTSTEEGTSESATPESGPGSEPATSGSETPASSELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 604 - DNA, 4536 bp, Artificial Sequence
  Description of Artificial Sequence: Synthetic polynucleotide
gccaccagaagatactacctgggtgcagtggaactgtcatgggactatatgcaaagtgatctcggtggcgcgccaggttctcctgctggctcccccacctcaacagaagaggggacaagcgaaagcgctacgcctgagagtggccctggctctgagccagccacctccggctctgaaacccctgcctcgagcgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 605 - protein, 1511 aa, Artificial Sequence
  Description of Artificial Sequence: Synthetic polypeptide
ATRRYYLGAVELSWDYMQSDLGELPVGAPGSPAGSPTSTEEGTSESATPESGPGSEPATSGSETPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 606 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggttctcctgctggctcccccacctcaacagaagaggggacaagcgaaagcgctacgcctgagagtggccctggctctgagccagccacctccggctctgaaacccctgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 607 - protein, 1511 aa, Artificial Sequence
  Description of Artificial Sequence: Synthetic polypeptide
ATRRYYLGAVELSWDYMQSDLGELPVDARFPPRVPKSFPFGAPGSPAGSPTSTEEGTSESATPESGPGSEPATSGSETPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 608 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggttctcctgctggctcccccacctcaacagaagaggggacaagcgaaagcgctacgcctgagagtggccctggctctgagccagccacctccggctctgaaacccctgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 609 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNGAPGSPAGSPTSTEEGTSESATPESGPGSEPATSGSETPASSIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 610 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacggcgcgccaggttctcctgctggctcccccacctcaacagaagaggggacaagcgaaagcgctacgcctgagagtggccctggctctgagccagccacctccggctctgaaacccctgcctcgagcatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 611 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDGAPGSPAGSPTSTEEGTSESATPESGPGSEPATSGSETPASSQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 612 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatggcgcgccaggttctcctgctggctcccccacctcaacagaagaggggacaagcgaaagcgctacgcctgagagtggccctggctctgagccagccacctccggctctgaaacccctgcctcgagccagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 613 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGAPGSPAGSPTSTEEGTSESATPESGPGSEPATSGSETPASSGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 614 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggcgcgccaggttctcctgctggctcccccacctcaacagaagaggggacaagcgaaagcgctacgcctgagagtggccctggctctgagccagccacctccggctctgaaacccctgcctcgagcggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 615 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKGAPGSPAGSPTSTEEGTSESATPESGPGSEPATSGSETPASSTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 616 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagggcgcgccaggttctcctgctggctcccccacctcaacagaagaggggacaagcgaaagcgctacgcctgagagtggccctggctctgagccagccacctccggctctgaaacccctgcctcgagcacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 617 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLGAPGSPAGSPTSTEEGTSESATPESGPGSEPATSGSETPASSMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 618 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgggcgcgccaggttctcctgctggctcccccacctcaacagaagaggggacaagcgaaagcgctacgcctgagagtggccctggctctgagccagccacctccggctctgaaacccctgcctcgagcatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 619 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKGAPGSPAGSPTSTEEGTSESATPESGPGSEPATSGSETPASSMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 620 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaggcgcgccaggttctcctgctggctcccccacctcaacagaagaggggacaagcgaaagcgctacgcctgagagtggccctggctctgagccagccacctccggctctgaaacccctgcctcgagcatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 621 - protein, 1514 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPGAPGSPAGSPTSTEEGTSESATPESGPGSEPATSGSETPASSVQLQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 622 - DNA, 4545 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaacccggcgcgccaggttctcctgctggctcccccacctcaacagaagaggggacaagcgaaagcgctacgcctgagagtggccctggctctgagccagccacctccggctctgaaacccctgcctcgagcgtgcaacttcaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 623 - protein, 1514 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVASVAGAPGSPAGSPTSTEEGTSESATPESGPGSEPATSGSETPASSKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 624 - DNA, 4545 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgcctctgtagcaggcgcgccaggttctcctgctggctcccccacctcaacagaagaggggacaagcgaaagcgctacgcctgagagtggccctggctctgagccagccacctccggctctgaaacccctgcctcgagcaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 625 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGSPAGSPTSTEEGTSESATPESGPGSEPATSGSETPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 626 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggttctcctgctggctcccccacctcaacagaagaggggacaagcgaaagcgctacgcctgagagtggccctggctctgagccagccacctccggctctgaaacccctgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 627 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIGAPGSPAGSPTSTEEGTSESATPESGPGSEPATSGSETPASSQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 628 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattggcgcgccaggttctcctgctggctcccccacctcaacagaagaggggacaagcgaaagcgctacgcctgagagtggccctggctctgagccagccacctccggctctgaaacccctgcctcgagccagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 629 - protein, 1514 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGAPGSPAGSPTSTEEGTSESATPESGPGSEPATSGSETPASSLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 630 - DNA, 4545 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagactccctaaaggcgcgccaggttctcctgctggctcccccacctcaacagaagaggggacaagcgaaagcgctacgcctgagagtggccctggctctgagccagccacctccggctctgaaacccctgcctcgagcttaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 631 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEGAPGSPAGSPTSTEEGTSESATPESGPGSEPATSGSETPASSDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 632 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaaggcgcgccaggttctcctgctggctcccccacctcaacagaagaggggacaagcgaaagcgctacgcctgagagtggccctggctctgagccagccacctccggctctgaaacccctgcctcgagcgatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 633 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGSPAGSPTSTEEGTSESATPESGPGSEPATSGSETPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 634 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggttctcctgctggctcccccacctcaacagaagaggggacaagcgaaagcgctacgcctgagagtggccctggctctgagccagccacctccggctctgaaacccctgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 635 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKGAPGSPAGSPTSTEEGTSESATPESGPGSEPATSGSETPASSNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 636 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagggcgcgccaggttctcctgctggctcccccacctcaacagaagaggggacaagcgaaagcgctacgcctgagagtggccctggctctgagccagccacctccggctctgaaacccctgcctcgagcaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 637 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGSPAGSPTSTEEGTSESATPESGPGSEPATSGSETPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 638 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggttctcctgctggctcccccacctcaacagaagaggggacaagcgaaagcgctacgcctgagagtggccctggctctgagccagccacctccggctctgaaacccctgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 639 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGSPAGSPTSTEEGTSESATPESGPGSEPATSGSETPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 640 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggttctcctgctggctcccccacctcaacagaagaggggacaagcgaaagcgctacgcctgagagtggccctggctctgagccagccacctccggctctgaaacccctgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 641 - protein, 1763 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 642 - DNA, 5292 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 643 - protein, 1763 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 644 - DNA, 5292 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 645 - protein, 1514 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGSPAGSPTSTEEGTSESATPESGPGSEPATSGSETPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 646 - DNA, 4545 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggttctcctgctggctcccccacctcaacagaagaggggacaagcgaaagcgctacgcctgagagtggccctggctctgagccagccacctccggctctgaaacccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 647 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQGAPGSPAGSPTSTEEGTSESATPESGPGSEPATSGSETPASSRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 648 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagggcgcgccaggttctcctgctggctcccccacctcaacagaagaggggacaagcgaaagcgctacgcctgagagtggccctggctctgagccagccacctccggctctgaaacccctgcctcgagcaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 649 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPGAPGSPAGSPTSTEEGTSESATPESGPGSEPATSGSETPASSRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 650 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctggcgcgccaggttctcctgctggctcccccacctcaacagaagaggggacaagcgaaagcgctacgcctgagagtggccctggctctgagccagccacctccggctctgaaacccctgcctcgagcagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 651 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKGAPGSPAGSPTSTEEGTSESATPESGPGSEPATSGSETPASSDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 652 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaaggcgcgccaggttctcctgctggctcccccacctcaacagaagaggggacaagcgaaagcgctacgcctgagagtggccctggctctgagccagccacctccggctctgaaacccctgcctcgagcgatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 653 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNGAPGSPAGSPTSTEEGTSESATPESGPGSEPATSGSETPASSTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 654 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacggcgcgccaggttctcctgctggctcccccacctcaacagaagaggggacaagcgaaagcgctacgcctgagagtggccctggctctgagccagccacctccggctctgaaacccctgcctcgagcacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 655 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMEGAPGSPAGSPTSTEEGTSESATPESGPGSEPATSGSETPASSRNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 656 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaggcgcgccaggttctcctgctggctcccccacctcaacagaagaggggacaagcgaaagcgctacgcctgagagtggccctggctctgagccagccacctccggctctgaaacccctgcctcgagcagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 657 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGSPAGSPTSTEEGTSESATPESGPGSEPATSGSETPASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 658 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaggttctcctgctggctcccccacctcaacagaagaggggacaagcgaaagcgctacgcctgagagtggccctggctctgagccagccacctccggctctgaaacccctgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 659 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNGAPGSPAGSPTSTEEGTSESATPESGPGSEPATSGSETPASSIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 660 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatggcgcgccaggttctcctgctggctcccccacctcaacagaagaggggacaagcgaaagcgctacgcctgagagtggccctggctctgagccagccacctccggctctgaaacccctgcctcgagcatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 661 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDGAPGSPAGSPTSTEEGTSESATPESGPGSEPATSGSETPASSQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 662 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatggcgcgccaggttctcctgctggctcccccacctcaacagaagaggggacaagcgaaagcgctacgcctgagagtggccctggctctgagccagccacctccggctctgaaacccctgcctcgagccaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 663 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNGAPGSPAGSPTSTEEGTSESATPESGPGSEPATSGSETPASSKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 664 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaatggcgcgccaggttctcctgctggctcccccacctcaacagaagaggggacaagcgaaagcgctacgcctgagagtggccctggctctgagccagccacctccggctctgaaacccctgcctcgagcaagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 665 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFGAPGSPAGSPTSTEEGTSESATPESGPGSEPATSGSETPASSSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 666 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagccctttggcgcgccaggttctcctgctggctcccccacctcaacagaagaggggacaagcgaaagcgctacgcctgagagtggccctggctctgagccagccacctccggctctgaaacccctgcctcgagctcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 667 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKGAPGSPAGSPTSTEEGTSESATPESGPGSEPATSGSETPASSWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 668 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagggcgcgccaggttctcctgctggctcccccacctcaacagaagaggggacaagcgaaagcgctacgcctgagagtggccctggctctgagccagccacctccggctctgaaacccctgcctcgagctggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 669 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGAPGSPAGSPTSTEEGTSESATPESGPGSEPATSGSETPASSGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 670 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggcgcgccaggttctcctgctggctcccccacctcaacagaagaggggacaagcgaaagcgctacgcctgagagtggccctggctctgagccagccacctccggctctgaaacccctgcctcgagcggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 671 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLGAPGSPAGSPTSTEEGTSESATPESGPGSEPATSGSETPASSNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 672 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaggcgcgccaggttctcctgctggctcccccacctcaacagaagaggggacaagcgaaagcgctacgcctgagagtggccctggctctgagccagccacctccggctctgaaacccctgcctcgagcaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 673 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAGAPGSPAGSPTSTEEGTSESATPESGPGSEPATSGSETPASSQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 674 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcaggcgcgccaggttctcctgctggctcccccacctcaacagaagaggggacaagcgaaagcgctacgcctgagagtggccctggctctgagccagccacctccggctctgaaacccctgcctcgagccagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 675 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKGAPGSPAGSPTSTEEGTSESATPESGPGSEPATSGSETPASSEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 676 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaaggcgcgccaggttctcctgctggctcccccacctcaacagaagaggggacaagcgaaagcgctacgcctgagagtggccctggctctgagccagccacctccggctctgaaacccctgcctcgagcgagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 677 - protein, 1511 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGAPGSPAGSPTSTEEGTSESATPESGPGSEPATSGSETPASSGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 678 - DNA, 4536 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcgcgccaggttctcctgctggctcccccacctcaacagaagaggggacaagcgaaagcgctacgcctgagagtggccctggctctgagccagccacctccggctctgaaacccctgcctcgagcggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 679 - protein, 1762 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGAETAEQKLISEEDLSPATGHHHHHH

SEQ ID NO: 680 - DNA, 5289 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccaggggccgaaacggccgaacaaaaactcatctcagaagaggatctgtcacctgcaaccggtcatcatcaccatcaccattga

SEQ ID NO: 681 - protein, 1762 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSGAETAEQKLISEEDLSPATGHHHHHH

SEQ ID NO: 682 - DNA, 5289 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcaggggccgaaacggccgaacaaaaactcatctcagaagaggatctgtcacctgcaaccggtcatcatcaccatcaccattga

SEQ ID NO: 683 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 684 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 685 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 686 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 687 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 688 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 689 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 690 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 691 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 692 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 693 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 694 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 695 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 696 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 697 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 698 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 699 - protein, 1622 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 700 - DNA, 4869 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 701 - protein, 1622 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 702 - DNA, 4869 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 703 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 704 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 705 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 706 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 707 - protein, 1609 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 708 - DNA, 4830 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 709 - protein, 1609 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSASSEQKLISEEDLSPATGHHHHHH

SEQ ID NO: 710 - DNA, 4830 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagcgaacaaaaactcatctcagaagaggatctgtcacctgcaaccggtcatcatcaccatcaccattga

SEQ ID NO: 711 - protein, 1763 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 712 - DNA, 5292 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 713 - protein, 1763 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 714 - DNA, 5292 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 715 - protein, 1753 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 716 - DNA, 5262 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 717 - protein, 1753 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 718 - DNA, 5262 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 719 - protein, 2329 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 720 - DNA, 6990 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggttctccagccgggtccccaacttcgaccgaggaagggacctccgagtcagctaccccggagtccggtcctggcacctccaccgaaccatcggagggcagcgcccctgggagccctgccgggagccctacaagcaccgaagagggcaccagtacagagccaagtgaggggagcgcccctggtactagtactgaaccatccgaggggtcagctccaggcacgagtgagtccgctacccccgagagcggaccgggctcagagcccgccacgagtggcagtgaaactccaggctcagaacccgccactagtgggtcagagactccaggcagccctgccggatcccctacgtccaccgaggagggaacatctgagtccgcaacacccgaatccggtccaggcacctccacggaacctagtgaaggctcggcaccaggtacaagcaccgaacctagcgagggcagcgctcccggcagccctgccggcagcccaacctcaactgaggagggcaccagtactgagcccagcgagggatcagcacctggcaccagcaccgaacctagcgaggggagcgcccctgggactagcgagtcagctacaccagagagcgggcctggaacttctaccgaacccagtgagggatccgctccaggcacctccgaatccgcaacccccgaatccggacctggctcagagcccgccaccagcgggagcgaaacccctggcacatccaccgagcctagcgaagggtccgcacccggcaccagtacagagcctagcgagggatcagcacctggcaccagtgaatctgctacaccagagagcggccctggaacctccgagtccgctacccccgagagcgggccaggttctcctgctggctcccccacctcaacagaagaggggacaagcgaaagcgctacgcctgagagtggccctggctctgagccagccacctccggctctgaaacccctggcactagtgagtctgccacgcctgagtccggacccgggacctctactgagccctcggaggggagcgctcctggcacgagtacagaaccttccgaaggaagtgcaccgggcacaagcaccgagccttccgaaggctctgctcccggaacctctaccgaaccctctgaagggtctgcacccggcacgagcaccgaacccagcgaagggtcagcgcctgggacctcaacagagccctcggaaggatcagcgcctggaagccctgcagggagtccaacttccacggaagaaggaacgtctacagagccatcagaggggtccgcaccaggtaccagcgaatccgctactcccgaatctggccctgggtccgaacctgccacctccggctctgaaactccagggacctccgaatctgccacacccgagagcggccctggctccgagcccgcaacatctggcagcgagacacctggcacctccgagagcgcaacacccgagagcggccctggcaccagcaccgagccatccgagggatccgccccaggcacttctgagtcagccacacccgaaagcggaccaggatcacccgctggctcccccaccagtaccgaggaggggtcccccgctggaagtccaacaagcactgaggaagggtcccctgccggctcccccacaagtaccgaagagggcacaagtgagagcgccactcccgagtccgggcctggcaccagcacagagccttccgaggggtccgcaccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 721 - protein, 2329 aa, Artificial Sequence [sequence omitted]

SEQ ID NO: 722 - DNA, 6990 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccgggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctggtacgcccgggtcgggaacagcgtcctcaagcccgggtagctcgacgccgtcaggagccacagggtcgccgggatcgtcgactccatcaggcgcaacgggatcgcctggatcaagcactccatccggagcgacgggaagcccagggagctccccgtccgcatcgactgggacgggacctggagcaagccccggtacgtcgtcaacaggttcgcctggtgcctcgcctggcacgtccagcacggggagccccggaacgccgggttccggaaccgcatcctcctcaccaggtgcctcaccgggcacctcatcaacgggatcaccaggggcttcaccgggaacgagctcgacgggttcaccgggagcgtccccggggacttcgtcgacaggtagcccaggggcaagccccggtacatcgtcaacgggttccccagggacaccggggagcggtactgcatcgtcctcacccggttcctcgacacccagcggagccacgggttcgcccggtactccggggtccggaacggccagcagctcacccggttcctcgacgccatcaggtgccacgggctcgcctggaacgccaggctcgggcactgcgagcagcagccctggatcatcaacgcctagcggagcgaccggctcccctggatcgtcaactccctcgggcgcgactgggagcccaggaagctcaccgtcggcctcgacgggaacagggcctggttcgagcccctcagcttcaacaggaacaggtccaggcgcgtcgccaggtacatcatcgacgggttcgcctgggacccctgggtccggtactgcctcatcatcgcccggatcgtccaccccctcgggagcgacaggttcgcctggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgaacaaaaactcatctcagaagaggatctgtcacctgcaaccggtcatcatcaccatcaccattga

SEQ ID NO: 723 - protein, 1619 aa, Artificial Sequence
  Description of Artificial Sequence: Synthetic polypeptide
GAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 724 - DNA, 4860 bp, Artificial Sequence
  Description of Artificial Sequence: Synthetic polynucleotide
ggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 725 - protein, 1619 aa, Artificial Sequence
  Description of Artificial Sequence: Synthetic polypeptide
ATRRYYLGAVELSWDYMQSDLGELPVDARFPPGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 726 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 727 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 728 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 729 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 730 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 731 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 732 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagccaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 733 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSEGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSTKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 734 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 735 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 736 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggataggggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 737 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 738 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 739 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 740 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 741 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 742 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaatggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 743 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 744 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagccctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 745 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 746 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 747 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 748 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagccaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 749 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 750 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagccagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 751 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 752 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagctcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 753 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 754 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 755 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 756 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagctttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 757 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 758 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 759 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 760 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 761 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 762 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 763 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 764 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 765 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 766 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 767 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 768 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 769 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 770 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 771 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 772 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 773 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 774 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 775 - protein, 1619 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 776 - DNA, 4860 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 777 - protein, 1619 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 778 - DNA, 4860 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 779 - protein, 1619 aa, Artificial Sequence
  Description of Artificial Sequence: Synthetic polypeptide
ATRRYYLGAVELSWDYMQSDLGGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 780 - DNA, 4860 bp, Artificial Sequence
  Description of Artificial Sequence: Synthetic polynucleotide
gccaccagaagatactacctgggtgcagtggaactgtcatgggactatatgcaaagtgatctcggtggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 781 - protein, 1619 aa, Artificial Sequence
  Description of Artificial Sequence: Synthetic polypeptide
ATRRYYLGAVELSWDYMQSDLGGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 782 - DNA, 4860 bp, Artificial Sequence
  Description of Artificial Sequence: Synthetic polynucleotide
gccaccagaagatactacctgggtgcagtggaactgtcatgggactatatgcaaagtgatctcggtggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 783 - protein, 1619 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 784 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 785 - protein, 1619 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 786 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 787 - protein, 1619 aa, Artificial Sequence
  Description of Artificial Sequence: Synthetic polypeptide
ATRRYYLGAVELSWDYMQSDLGELPVDARFPPRVPKSFPFGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 788 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 789 - protein, 1619 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 790 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 791 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 792 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 793 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 794 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 795 - protein, 1622 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVASVAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 796 - DNA, 4869 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgcctctgtagcaggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 797 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 798 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagccagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 799 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 800 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagccagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 801 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 802 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 803 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 804 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 805 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 806 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 807 - protein, 1619 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 808 - DNA, 4860 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 809 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 810 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 811 - protein, 1759 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 812 - DNA, 5280 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 813 - protein, 1759 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 814 - DNA, 5280 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 815 - protein, 1759 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 816 - DNA, 5280 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 817 - protein, 1759 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 818 - DNA, 5280 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 819 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 820 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 821 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 822 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 823 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGASSEQKLISEEDLSPATGHHHHHH

SEQ ID NO: 824 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagcgaacaaaaactcatctcagaagaggatctgtcacctgcaaccggtcatcatcaccatcaccattga

SEQ ID NO: 825 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSASSEQKLISEEDLSPATGHHHHHH

SEQ ID NO: 826 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagcgaacaaaaactcatctcagaagaggatctgtcacctgcaaccggtcatcatcaccatcaccattga

SEQ ID NO: 827 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSASSEQKLISEEDLSPATGHHHHHH

SEQ ID NO: 828 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagcgaacaaaaactcatctcagaagaggatctgtcacctgcaaccggtcatcatcaccatcaccattga

SEQ ID NO: 829 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSASSEQKLISEEDLSPATGHHHHHH

SEQ ID NO: 830 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagcgaacaaaaactcatctcagaagaggatctgtcacctgcaaccggtcatcatcaccatcaccattga

SEQ ID NO: 831 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 832 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 833 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 834 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 835 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 836 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 837 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 838 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 839 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 840 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 841 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 842 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 843 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 844 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 845 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 846 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 847 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 848 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 849 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 850 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 851 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 852 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 853 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 854 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 855 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 856 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 857 - protein, 1769 aa, Artificial Sequence
  Description of Artificial Sequence: Synthetic polypeptide
ATRRYYLGAVELSWDYMQSDLGELPVDARFPPRVPKSFPFGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 858 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 859 - protein, 1769 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 860 - DNA, 5310 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 861 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 862 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 863 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 864 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 865 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 866 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 867 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 868 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 869 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 870 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 871 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 872 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 873 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 874 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 875 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 876 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 877 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 878 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 879 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 880 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 881 - protein, 1769 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 882 - DNA, 5310 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 883 - protein, 1769 aa, Artificial Sequence
  Description of Artificial Sequence: Synthetic polypeptide
ATRRYYLGAVELSWDYMQSDLGELPVDARFPPRVPKSFPFGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 884 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 885 - protein, 1759 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSASSEQKLISEEDLSPATGHHHHHH

SEQ ID NO: 886 - DNA, 5280 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagcgaacaaaaactcatctcagaagaggatctgtcacctgcaaccggtcatcatcaccatcaccattga

SEQ ID NO: 887 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSASSEQKLISEEDLSPATGHHHHHH

SEQ ID NO: 888 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagcgaacaaaaactcatctcagaagaggatctgtcacctgcaaccggtcatcatcaccatcaccattga

SEQ ID NO: 889 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPASSPPVLKRHQAEITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 890 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagcccaccagtcttgaaacgccatcaagctgaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 891 - protein, 1903 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSASSEQKLISEEDLSPATGHHHHHH

SEQ ID NO: 892 - DNA, 5712 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaccgggagcgtcacccggtacgtcctcaacggggagccctggggcatcacccggcacgtcctcgacagggtcccccggaacaccgggttcggggactgcgtcgtcgtcacccggttcgtcaacacccagcggtgcgacgggttccccgggaacccccggatcaggaacagcgtcgtcgagccccggaagctcgaccccgtcaggagcgaccgggtcgccaggaacgcctgggtcgggtactgcctcatcgtcgccgggttcatcgacgccctccggagcaacaggttcacccgggtcgtccacccccagcggagcgactggatcaccgggatcgagcccgtcggcatcgacaggaacaggtcccggtagctccccatcggcctccacggggacggggcctggtgcgtcaccggggacaagcagcacgggttcgccgggaacgccagggtcagggaccgcgtcgtcgagcccagggtcgtccaccccaagcggggctactgggtccccgggtagctcgccgagcgcatcaacgggaaccggaccgggcagctccccctcagcgtcgacagggacaggccctggcgcgagcccgggaacatcgtcgacggggtcacccggagcatcgccagggacctcgtcaactggctcgcctggatcgtcaacgccctcgggagccacggggtcgcccggatcatccccgtccgcctcaactggcacaggccctggtgcttcccctggaacgtccagcacaggctcccccggttccagcccttccgcttcgactgggactggacccggaaccccgggatcggggacagcgtcaagctcgcccggaagctccacgccttcgggggcaaccgggtcagcctcgagcgaacaaaaactcatctcagaagaggatctgtcacctgcaaccggtcatcatcaccatcaccattga

SEQ ID NO: 893 - protein, 2047 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPASSEQKLISEEDLSPATGHHHHHH

SEQ ID NO: 894 - DNA, 6144 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgcgccaggtacctcagagtctgctacccccgagtcagggccaggatcagagccagccacctccgggtctgagacacccgggacttccgagagtgccacccctgagtccggacccgggtccgagcccgccacttccggctccgaaactcccggcacaagcgagagcgctaccccagagtcaggaccaggaacatctacagagccctctgaaggctccgctccagggtccccagccggcagtcccactagcaccgaggagggaacctctgaaagcgccacacccgaatcagggccagggtctgagcctgctaccagcggcagcgagacaccaggcacctctgagtccgccacaccagagtccggacccggatctcccgctgggagccccacctccactgaggagggatctcctgctggctctccaacatctactgaggaaggtacctcaaccgagccatccgagggatcagctcccggcacctcagagtcggcaaccccggagtctggacccggaacttccgaaagtgccacaccagagtccggtcccgggacttcagaatcagcaacacccgagtccggccctgggtctgaacccgccacaagtggtagtgagacaccaggatcagaacctgctacctcagggtcagagacacccggatctccggcaggctcaccaacctccactgaggagggcaccagcacagaaccaagcgagggctccgcacccggaacaagcactgaacccagtgagggttcagcacccggctctgagccggccacaagtggcagtgagacacccggcacttcagagagtgccacccccgagagtggcccaggcactagtaccgagccctctgaaggcagtgcgccagcctcgagcgaacaaaaactcatctcagaagaggatctgtcacctgcaaccggtcatcatcaccatcaccattga

SEQ ID NO: 895 - protein, 1769 aa, Artificial Sequence; identical to SEQ ID NO: 871
  Description of Artificial Sequence: Synthetic polypeptide

SEQ ID NO: 896 - DNA, 5310 bp, Artificial Sequence; identical to SEQ ID NO: 872
  Description of Artificial Sequence: Synthetic polynucleotide

SEQ ID NO: 897 - protein, 1772 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 898 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 899 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 900 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 901 - protein, 1772 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 902 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 903 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 904 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 905 - protein, 1772 aa, Artificial Sequence [sequence omitted]

SEQ ID NO: 906 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 907 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 908 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 909 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 910 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 911 - protein, 1769 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 912 - DNA, 5310 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 913 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 914 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 915 - protein, 1769 aa, Artificial Sequence
  Description of Artificial Sequence: Synthetic polypeptide
ATRRYYLGAVELSWDYMQSDLGELPVDARFPPRVPKSFPFGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 916 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 917 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 918 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 919 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 920 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 921 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 922 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 923 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 924 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 925 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 926 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 927 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 928 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 929 - protein, 1772 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 930 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 931 - protein, 1769 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 932 - DNA, 5310 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 933 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 934 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 935 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 936 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 937 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 938 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 939 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 940 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 941 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 942 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 943 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 944 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 945 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 946 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 947 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 948 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 949 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 950 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 951 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 952 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 953 - protein, 1769 aa, Artificial Sequence
  Description of Artificial Sequence: Synthetic polypeptide
ATRRYYLGAVELSWDYMQSDLGELPVDARFPPRVPKSFPFGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 954 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 955 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 956 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 957 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 958 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 959 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 960 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 961 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 962 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 963 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 964 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 965 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 966 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 967 - protein, 1769 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 968 - DNA, 5310 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 969 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 970 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 971 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 972 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 973 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 974 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 975 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 976 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 977 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 978 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 979 - protein, 1772 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 980 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 981 - protein, 1772 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 982 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 983 - protein, 1772 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 984 - DNA, 5319 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 985 - protein, 1772 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 986 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 987 - protein, 1772 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 988 - DNA, 5319 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 989 - protein, 1769 aa, Artificial Sequence
  Description of Artificial Sequence: Synthetic polypeptide
ATRRYYLGAVELSWDYMQSDLGELPVGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 990 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 991 - protein, 1769 aa, Artificial Sequence
  Description of Artificial Sequence: Synthetic polypeptide
ATRRYYLGAVELSWDYMQSDLGELPVDARFPPRVPKSFPFGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 992 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 993 - protein, 1769 aa, Artificial Sequence
  Description of Artificial Sequence: Synthetic polypeptide
ATRRYYLGAVELSWDYMQSDLGELPVGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 994 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtgggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 995 - protein, 1769 aa, Artificial Sequence
  Description of Artificial Sequence: Synthetic polypeptide
ATRRYYLGAVELSWDYMQGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 996 - DNA, 5310 bp, Artificial Sequence
  Description of Artificial Sequence: Synthetic polynucleotide
gccaccagaagatactacctgggtgcagtggaactgtcatgggactatatgcaaggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 997 - protein, 1769 aa, Artificial Sequence
  Description of Artificial Sequence: Synthetic polypeptide
ATRRYYLGAVELSWDYMQSDLGELPVDARFPPRVPKSFPFGAPTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 998 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 999 - protein, 1769 aa, Artificial Sequence
  Description of Artificial Sequence: Synthetic polypeptide
ATRRYYLGAVELSWDYMQGAPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSPASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 1000 - DNA, 5310 bp, Artificial Sequence
  Description of Artificial Sequence: Synthetic polynucleotide
gccaccagaagatactacctgggtgcagtggaactgtcatgggactatatgcaaggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 1001 - protein, 1772 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 1002 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 1003 - protein, 1772 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 1004 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 1005 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 1006 - DNA, 5310 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagcagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 1007 - protein, 1772 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 1008 - DNA, 5319 bp, Artificial Sequence
  Description of Artificial Sequence: Synthetic polynucleotide
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccattga

SEQ ID NO: 1009 - protein, 1769 aa, Artificial Sequence
  Description of Artificial Sequence: Synthetic polypeptide
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGGAPTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGASSSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

(The sequence listing continues in the following parts.)

What is claimed is:

1. A recombinant factor VIII fusion protein comprising a factor VIII polypeptide fused to at least one extended recombinant polypeptide (XTEN),
   wherein amino acid residue R1648 corresponding to mature native human factor VIII (SEQ ID NO: 2) in the factor VIII polypeptide is deleted, and
   wherein the XTEN is inserted within the factor VIII polypeptide immediately downstream of an amino acid corresponding to amino acid 745 of mature native human factor VIII (SEQ ID NO:2).

2. The recombinant factor VIII fusion protein of claim 1, comprising at least two XTENs.

3. The recombinant factor VIII fusion protein of claim 2, wherein the at least two XTENs are inserted immediately downstream of one or two amino acids corresponding to an amino acid in mature native human factor VIII selected from amino acid 745 of SEQ ID NO: 2 and amino acid 1332 of SEQ ID NO: 2.

4. The recombinant factor VIII fusion protein of claim 2, comprising at least three XTENs, at least four XTENs, at least five XTENs, or at least six XTENs.

5. The recombinant factor VIII fusion protein of claim 4, wherein
   i. the at least three XTENs are inserted or fused immediately downstream of one or more amino acids corresponding to amino acid 745 of mature native human factor VIII (SEQ ID NO: 2) and an amino acid in mature native human factor VIII selected from amino acid 18 of SEQ ID NO: 2, amino acid 26 of SEQ ID NO: 2, amino acid 40 of SEQ ID NO: 2, amino acid 399 of SEQ ID NO: 2, amino acid 403 of SEQ ID NO: 2, amino acid 599 of SEQ ID NO: 2, amino acid 1656 of SEQ ID NO: 2, amino acid 1711 of SEQ ID NO: 2, amino acid 1720 of SEQ ID NO: 2, amino acid 1725 of SEQ ID NO: 2, amino acid 1900 of SEQ ID NO: 2, amino acid 1905 of SEQ ID NO: 2, amino acid 1910 of SEQ ID NO: 2, and amino acid 2332 of SEQ ID NO: 2;

ii. the at least four XTENs are inserted or fused immediately downstream of one or more amino acids corresponding to amino acid 745 of mature native human factor VIII (SEQ ID NO: 2) and an amino acid in mature native human factor VIII selected from amino acid 18 of SEQ ID NO: 2, amino acid 26 of SEQ ID NO: 2, amino acid 40 of SEQ ID NO: 2, amino acid 403 of SEQ ID NO: 2, amino acid 409 of SEQ ID NO: 2, amino acid 1656 of SEQ ID NO: 2, amino acid 1720 of SEQ ID NO: 2, amino acid 1900 of SEQ ID NO: 2, amino acid 1905 of SEQ ID NO: 2, amino acid 1910 of SEQ ID NO: 2, and amino acid 2332 of SEQ ID NO: 2; or iii. the at least five XTENs are inserted or fused immediately downstream of one or more amino acids corresponding to amino acid 745 of mature native human factor VIII (SEQ ID NO: 2) and an amino acid in mature native human factor VIII selected from amino acid 18 of SEQ ID NO: 2, amino acid 403 of SEQ ID NO: 2, amino acid 745 of SEQ ID NO: 2, amino acid 1656 of SEQ ID NO: 2, amino acid 1720 of SEQ ID NO: 2, amino acid 1900 of SEQ ID NO: 2, and amino acid 2332 of SEQ ID NO: 2.

6. The recombinant factor VIII fusion protein of claim 1, wherein the at least one XTEN comprises at least 36 amino acids, at least 42 amino acids, at least 72 amino acids, at least 96 amino acids, at least 144 amino acids, or at least 288 amino acids.

7. The recombinant factor VIII fusion protein of claim 1, wherein the at least one XTEN comprises at least 144 amino acids.

8. The recombinant factor VIII fusion protein of claim 1, wherein the at least one XTEN comprises at least 288 amino acids.

9. The recombinant factor VIII fusion protein of claim 1, wherein the at least one XTEN comprises an amino acid sequence having at least 90% sequence identity to an amino acid sequence selected from the group consisting of SEQ ID NOs: 19-48 and any combination thereof.

10. The recombinant factor VIII fusion protein of claim 1, wherein the at least one XTEN comprises an amino acid sequence selected from the group consisting of SEQ ID NOs: 23, 24, 25, 26, and any combination thereof.

11. The recombinant factor VIII fusion protein of claim 1, wherein the at least one XTEN comprises an amino acid sequence at least 90% identical to an amino acid sequence selected from the group consisting of SEQ ID NOs: 49, 50, 51, 52, 57, 59, 60, 61, 62, 63, 64, 65, 66, 67, 68, 78, 79, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, and any combination thereof.

12. The recombinant factor VIII fusion protein of claim 1, wherein the at least one XTEN comprises one or more XTEN sequence motifs, wherein the one or more XTEN sequence motifs comprise the amino acid sequence set forth in SEQ ID NO: 25.

13. The recombinant factor VIII fusion protein of claim 1, wherein the at least one XTEN comprises an amino acid sequence at least 95% identical to an amino acid sequence selected from the group consisting of SEQ ID NOs: 49, 50, 51, 52, 57, 59, 60, 61, 62, 63, 64, 65, 66, 67, 68, 78, 79, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, and any combination thereof.

14. The recombinant factor VIII fusion protein of claim 1, wherein the at least one XTEN comprises an amino acid sequence selected from the group consisting of SEQ ID NOs: 49, 50, 51, 52, 57, 59, 60, 61, 62, 63, 64, 65, 66, 67, 68, 78, 79, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, and any combination thereof.

15. The recombinant factor VIII fusion protein of claim 1, wherein the at least one XTEN comprises an amino acid sequence at least 90% identical to an amino acid sequence selected from the group consisting of SEQ ID NOs: 50, 52, 67, and 78.

16. The recombinant factor VIII fusion protein of claim 1, wherein the at least one XTEN comprises an amino acid sequence at least 95% identical to an amino acid sequence selected from the group consisting of SEQ ID NOs: 50, 52, 67, and 78.

17. The recombinant factor VIII fusion protein of claim 1, wherein the at least one XTEN comprises an amino acid sequence selected from the group consisting of SEQ ID NOs: 50, 52, 67, and 78.

18. The recombinant factor VIII fusion protein of claim 1, wherein the at least one XTEN comprises the amino acid sequence set forth in SEQ ID NO: 50.

19. The recombinant factor VIII fusion protein of claim 1, wherein the at least one XTEN comprises the amino acid sequence set forth in SEQ ID NO: 52.

20. The recombinant factor VIII fusion protein of claim 1, wherein the at least one XTEN comprises an amino acid sequence at least 95% identical to SEQ ID NO: 67.

21. The recombinant factor VIII fusion protein of claim 1, wherein the at least one XTEN comprises the amino acid sequence set forth in SEQ ID NO: 67.

22. The recombinant factor VIII fusion protein of claim 1, wherein the at least one XTEN comprises an amino acid sequence at least 95% identical to SEQ ID NO:78.

23. The recombinant factor VIII fusion protein of claim 1, wherein the at least one XTEN comprises the amino acid sequence set forth in SEQ ID NO:78.

24. The recombinant factor VIII fusion protein of claim 1, wherein the recombinant factor VIII fusion protein exhibits a prolonged terminal half-life when administered to a subject as compared to a corresponding factor VIII polypeptide lacking the one or more XTEN.

25. A pharmaceutical composition comprising the recombinant factor VIII fusion protein of claim 1 and a pharmaceutically acceptable carrier.

26. A recombinant factor VIII fusion protein comprising a factor VIII polypeptide comprising at least one extended recombinant polypeptide (XTEN),
  wherein the XTEN comprises at least 36 amino acids and an amino acid sequence having at least 80% sequence identity to an amino acid sequence selected from the group consisting of SEQ ID NOs: 19-48, and any combination thereof,
  wherein the at least one XTEN is inserted into the factor VIII polypeptide immediately downstream of an amino acid corresponding to amino acid 745 of mature native human factor VIII (SEQ ID NO:2), and wherein the amino acid residue R1648 corresponding to mature native human factor VIII (SEQ ID NO:2) in the factor VIII polypeptide is deleted.

27. The recombinant factor VIII fusion protein of claim 26, wherein the factor VIII polypeptide comprises only one XTEN.

28. The recombinant factor VIII fusion protein of claim 26, wherein the at least one XTEN comprises an amino acid sequence having at least 80% sequence identity to an amino acid sequence selected from the group consisting of SEQ ID NOs: 19-48 and any combination thereof.

29. The recombinant factor VIII fusion protein of claim 26, wherein the at least one XTEN comprises an amino acid sequence at least 95% identical to SEQ ID NO:67.

30. The recombinant factor VIII fusion protein of claim 26, wherein the at least one XTEN comprises the amino acid sequence set forth in SEQ ID NO:67.

31. A recombinant factor VIII fusion protein comprising a factor VIII polypeptide fused to at least one extended recombinant polypeptide (XTEN),
wherein the at least one XTEN is inserted within the factor VIII polypeptide immediately downstream of an amino acid corresponding to amino acid 745 of mature native human factor VIII (SEQ ID NO:2);
wherein the amino acid residue R1648 corresponding to mature native human factor VIII (SEQ ID NO:2) in the factor VIII polypeptide is deleted; and
wherein the at least one XTEN comprises an amino acid sequence at least 90% identical to an amino acid sequence selected from the group consisting of SEQ ID NOs: 50, 52, 67, 78, and any combination thereof.

32. The recombinant factor VIII fusion protein of claim 31, wherein the at least one XTEN comprises an amino acid sequence at least 95% identical to an amino acid sequence selected from the group consisting of SEQ ID NOs: 50, 52, 67, 78, and any combination thereof.

33. The recombinant factor VIII fusion protein of claim 31, wherein the at least one XTEN comprises an amino acid sequence selected from the group consisting of SEQ ID NOs: 50, 52, 67, 78, and any combination thereof.

34. The recombinant factor VIII fusion protein of claim 31, wherein the at least one XTEN comprises the amino acid sequence set forth in SEQ ID NO:50.

35. The recombinant factor VIII fusion protein of claim 31, wherein the at least one XTEN comprises the amino acid sequence set forth in SEQ ID NO:52.

36. The recombinant factor VIII fusion protein of claim 31, wherein the at least one XTEN comprises an amino acid sequence at least 95% identical to SEQ ID NO:67.

37. The recombinant factor VIII fusion protein of claim 31, wherein the at least one XTEN comprises the amino acid sequence set forth in SEQ ID NO:67.

38. The recombinant factor VIII fusion protein of claim 31, wherein the at least one XTEN comprises an amino acid sequence at least 95% identical to SEQ ID NO:78.

39. The recombinant factor VIII fusion protein of claim 31, wherein the at least one XTEN comprises the amino acid sequence set forth in SEQ ID NO:78.

40. The recombinant factor VIII fusion protein of claim 31, wherein the recombinant factor VIII fusion protein exhibits a prolonged terminal half-life when administered to a subject as compared to a corresponding factor VIII polypeptide lacking the one or more XTEN.

41. A recombinant factor VIII fusion protein comprising a factor VIII polypeptide fused to an extended recombinant polypeptide (XTEN),
wherein amino acid residue R1648 corresponding to mature native human factor VIII (SEQ ID NO: 2) in the factor VIII polypeptide is deleted,
wherein the XTEN comprises the amino acid sequence set forth in SEQ ID NO: 25, 50, 52, 67, or 78; and
wherein the XTEN is inserted within the factor VIII polypeptide immediately downstream of an amino acid corresponding to amino acid 745 of mature native human factor VIII (SEQ ID NO:2).

42. The recombinant factor VIII fusion protein of claim 41, wherein the factor VIII polypeptide comprises amino acids 1-745 of mature native human factor VIII (SEQ ID NO: 2).

43. The recombinant factor VIII fusion protein of claim 42, wherein the factor VIII polypeptide comprises amino acids 1649-2332 of mature native human factor VIII (SEQ ID NO: 2).

44. A recombinant factor VIII fusion protein comprising a factor VIII polypeptide fused to an extended recombinant polypeptide (XTEN),
wherein the factor VIII polypeptide comprises amino acids 1-745 and 1649-2332 of mature native human factor VIII (SEQ ID NO: 2);
wherein the XTEN 15 inserted within the factor VIII polypeptide immediately downstream of an amino acid corresponding to amino acid 745 of mature native human factor VIII (SEQ ID NO:2);
wherein the XTEN comprises the amino acid sequence set forth in SEQ ID NO: 78; and
wherein amino acid residue R1648 corresponding to mature native human factor VIII (SEQ ID NO: 2) is deleted in the factor VIII polypeptide.

* * * * *